(12) United States Patent
Cameron et al.

(10) Patent No.: US 10,227,576 B1
(45) Date of Patent: Mar. 12, 2019

(54) ENGINEERED CASCADE COMPONENTS AND CASCADE COMPLEXES

(71) Applicant: Caribou Biosciences, Inc., Berkeley, CA (US)

(72) Inventors: Peter Sean Cameron, San Francisco, CA (US); Sanne Eveline Klompe, New York, NY (US); Samuel Henry Stemberg, New York, NY (US)

(73) Assignee: Caribou Biosciences, Inc., Berkeley, CA (US)

( * ) Notice: Subject to any disclaimer, the term of this patent is extended or adjusted under 35 U.S.C. 154(b) by 0 days.

(21) Appl. No.: 16/104,875

(22) Filed: Aug. 17, 2018

Related U.S. Application Data

(60) Provisional application No. 62/684,735, filed on Jun. 13, 2018.

(51) Int. Cl.
| | |
|---|---|
| C12N 9/22 | (2006.01) |
| C12N 15/11 | (2006.01) |
| C07K 7/06 | (2006.01) |
| C07K 7/08 | (2006.01) |
| C12N 15/90 | (2006.01) |
| C07K 14/00 | (2006.01) |

(52) U.S. Cl.
CPC .............. *C12N 9/22* (2013.01); *C07K 7/06* (2013.01); *C07K 7/08* (2013.01); *C07K 14/00* (2013.01); *C12N 15/11* (2013.01); *C12N 15/902* (2013.01); *C12N 15/907* (2013.01); *C07K 2319/00* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | | |
|---|---|---|---|
| 8,865,406 B2 | 10/2014 | Zhang et al. | |
| 8,993,233 B2 | 3/2015 | Zhang et al. | |
| 9,260,752 B1 | 2/2016 | May et al. | |
| 9,410,198 B2 | 8/2016 | May et al. | |
| 9,725,714 B2 | 8/2017 | May et al. | |
| 9,803,194 B2 | 10/2017 | May et al. | |
| 9,809,814 B1 | 11/2017 | May et al. | |
| 9,856,497 B2 | 1/2018 | Qi et al. | |
| 9,885,026 B2 | 2/2018 | Brouns et al. | |
| 9,909,122 B2 | 3/2018 | May et al. | |
| 9,982,267 B2 | 5/2018 | Del'Guidice et al. | |
| 2010/0076057 A1 | 3/2010 | Sontheimer et al. | |
| 2013/0130248 A1 | 5/2013 | Haurwitz et al. | |
| 2014/0186843 A1 | 7/2014 | Zhang et al. | |
| 2014/0294773 A1 | 10/2014 | Brouns et al. | |
| 2014/0295556 A1 | 10/2014 | Joung et al. | |
| 2014/0302563 A1 | 10/2014 | Doudna et al. | |
| 2014/0315985 A1 | 10/2014 | May et al. | |
| 2015/0133315 A1 | 5/2015 | Jacobson et al. | |
| 2015/0152398 A1 | 6/2015 | Doudna et al. | |
| 2015/0376586 A1 | 12/2015 | May et al. | |
| 2016/0053272 A1 | 2/2016 | Wurtzel et al. | |
| 2016/0053304 A1 | 2/2016 | Wurtzel et al. | |
| 2016/0208243 A1 | 7/2016 | Zhang et al. | |
| 2016/0215300 A1 | 7/2016 | May et al. | |
| 2016/0345578 A1 | 12/2016 | Barrangou et al. | |
| 2017/0028083 A1 | 2/2017 | Beisel et al. | |
| 2017/0080107 A1 | 3/2017 | Chivukula et al. | |
| 2017/0151282 A1 | 6/2017 | Discher et al. | |
| 2017/0204372 A1 | 7/2017 | Mohler et al. | |
| 2017/0239370 A1 | 8/2017 | Zhu et al. | |
| 2017/0260546 A1 | 9/2017 | Qimron et al. | |
| 2017/0283779 A1 | 10/2017 | Holder et al. | |
| 2018/0044659 A1 | 2/2018 | Zhu et al. | |
| 2018/0049984 A1 | 2/2018 | Brinker et al. | |
| 2018/0112228 A1 | 4/2018 | Ecker et al. | |
| 2018/0112255 A1 | 4/2018 | Chen et al. | |
| 2018/0119121 A1 | 5/2018 | Brouns et al. | |
| 2018/0127745 A1 | 5/2018 | Konermann et al. | |
| 2018/0155729 A1 | 6/2018 | Beisel et al. | |
| 2018/0161368 A1 | 6/2018 | Odegard | |
| 2018/0179522 A1 | 6/2018 | Buckley et al. | |
| 2018/0223291 A1 | 8/2018 | Holder et al. | |
| 2018/0273962 A1* | 9/2018 | Kerstetter | C07K 14/415 |

FOREIGN PATENT DOCUMENTS

| | | |
|---|---|---|
| WO | WO 2013098244 | 7/2013 |
| WO | WO 2014018423 | 1/2014 |
| WO | WO 2014093479 | 6/2014 |

(Continued)

OTHER PUBLICATIONS

Wright et al entitled "Biology and Applications of CRISPR Systems: Harnessing Nature's Toolbox for Genome Engineering" (Cell vol. 164, Jan. 14, 2016) (Year: 2016).*
U.S. Appl. No. 14/997,474, filed Jan. 15, 2016.
U.S. Appl. No. 14/416,338, filed Jan. 22, 2015.
U.S. Appl. No. 14/751,055, filed Jun. 25, 2015.
U.S. Appl. No. 14/977,514, filed Dec. 21, 2015.
U.S. Appl. No. 15/159,619, filed May 19, 2016.
U.S. Appl. No. 15/202,518, filed Jun. 5, 2016.
U.S. Appl. No. 15/660,906, filed Jul. 26, 2017.
U.S. Appl. No. 15/802,413, filed Nov. 2, 2017.
U.S. Appl. No. 14/751,058, filed Jun. 25, 2015.
U.S. Appl. No. 15/344,487, filed Nov. 4, 2016.
U.S. Appl. No. 15/159,776, filed May 19, 2016.
U.S. Appl. No. 15/904,285, filed Feb. 23, 2018.

(Continued)

*Primary Examiner* — Catherine S Hibbert
(74) *Attorney, Agent, or Firm* — Gary R. Fabian; Barbara G. McClung

(57) ABSTRACT

The present disclosure provides engineered Class 1 Type I CRISPR-Cas (Cascade) systems that comprise multi-protein effector complexes, nucleoprotein complexes comprising Type I CRISPR-Cas subunit proteins and nucleic acid guides, polynucleotides encoding Type I CRISPR-Cas subunit proteins, and guide polynucleotides. Also, disclosed are methods for making and using the engineered Class 1 Type I CRISPR-Cas systems of the present invention.

20 Claims, 48 Drawing Sheets

Specification includes a Sequence Listing.

(56) References Cited

FOREIGN PATENT DOCUMENTS

| WO | WO 2015155686 | 10/2015 |
|---|---|---|
| WO | WO 2016053397 | 4/2016 |
| WO | WO 2016077350 | 5/2016 |
| WO | WO 2017066497 | 4/2017 |
| WO | WO 2017219033 | 12/2017 |

OTHER PUBLICATIONS

Beloglazova, N., et al., "Structure and activity of the Cas3 HD nuclease MJ0384, an effector enzyme of the CRISPR interference," EMBO Journal 30(22):4616-4627 (2011; doi:10.1038/emboj.2011. 377).

Beloglazova, N., et al., "CRISPR RNA binding and DNA target recognition by purified Cascade complexes from *Escherichia coli*," Nucleic Acids Research 43(1):530-543 (2015; doi:10.1093/nar/gku1285).

Brouns, S., et al., "Small CRISPR RNAs Guide Antiviral Defense in Prokaryotes," Science 321(5891):960-964 (2008; doi:10.1126/science.1159689).

Chen, X., et al., "Fusion Protein Linkers: Property, Design and Functionality," Advanced drug delivery reviews 65(10):1357-1369 (2013; doi:10.1016/j.addr.2012.09.039).

Chichili, V., et al., "Linkers in the structural biology of protein—protein interactions," Protein Science: a Publication of the Protein Society 22(2):153-167 (2013; doi:10.1002/pro.2206).

Choudhury, R., et al., "Engineering RNA endonucleases with customized sequence specificities," Nat. Commun. 3:1147 (2012; doi: 10.1038/ncomms2154).

Fu, B., et al., "High-Throughput Characterization of Cascade type I-E CRISPR Guide Efficacy Reveals Unexpected PAM Diversity and Target Sequence Preferences," Genetics 206(4):1727-1738 (Aug. 1, 2017; doi.org/10.1534/genetics.117.202580).

George, R., et al., "An analysis of protein domain linkers: their classification and role in protein folding," Protein Eng. 15(11):871-9 (Nov. 2003).

Gleditzsch, D., et al., "Modulating the Cascade architecture of a minimal Type I-F CRISPR-Cas system," Nucleic Acids Research 44(12):5872-5882 (2016; doi:10.1093/nar/gkw469).

Guilinger, J,. et al., "Fusion of catalytically inactive Cas9 to FokI nuclease improves the specificity of genome modification," Nat Biotechnol. 32(6):577-582 (Jun. 2014; doi: 10.1038/nbt.2909; Epub Apr. 25, 2014).

Hochstrasser, M., et al., "DNA Targeting by a Minimal CRISPR RNA-Guided Cascade," Molecular cell 63(5):840-851 (2016; doi:10. 1016/j.molcel.2016.07.027).

Huo, Y., et al., "Structures of CRISPR Cas3 offer mechanistic insights into Cascade-activated DNA unwinding and degradation," Nature structural & molecular biology 21(9):771-777 (2014; doi:10. 1038/nsmb.2875).

Jackson, R., et al., "Crystal structure of the CRISPR RNA—guided surveillance complex from *Escherichia coli*," Science 345(6203):1473-9 (Sep. 19, 2014; doi:10.1126/science.1256328. Epub Aug. 7, 2014).

Jore, M., et al., "Structural basis for CRISPR RNA-guided DNA recognition by Cascade" Nature Structural & Molecular Biology 18:529-537 (2011).

Kim, Y.G., et al., "Site-specific cleavage of DNA-RNA hybrids by zinc finger/FokI cleavage domain fusions," Gene 203(1):43-49 (Dec. 5, 1997).

Klein, J., et al., "Design and characterization of structured protein linkers with differing flexibilities," Protein Engineering, Design & Selection 27(10):325-30 (Oct. 2014; doi:10.1093/protein/gzu043).

Kuznedelov K., et al., "Altered stoichiometry *Escherichia coli* Cascade complexes with shortened CRISPR RNA spacers are capable of interference and primed adaptation," Nucleic Acids Research 44(22):10849-10861 (2016; doi:10.1093/nar/gkw914).

Luo, M., et al., "The CRISPR RNA-guided surveillance complex in *Escherichia coli* accommodates extended RNA spacers," Nucleic Acids Research 44(15):7385-7394 (2016; doi:10.1093/nar/gkw421).

Makarova, K., et al., "Evolution and classification of the CRISPR-Cas systems," Nat. Rev. Microbiol. 9(6): 467-477 (Jun. 2011; doi:10.1038/nrmicro2577).

Makarova, K., et al., "SnapShot: Class 1 CRISPR-Cas Systems," Cell 168(5):946-946.e1 (Feb. 23, 2017; doi: 10.1016/j.cell.2017. 02.018).

Mulepati, S., "Structural and Biochemical Analysis of Nuclease Domain of Clustered Regularly Interspaced Short Palindromic Repeat (CRISPR)-associated Protein 3 (Cas3)," Journal of Biological Chemistry 286(36):31896-31903 (2011; doi:10.1074/jbc.M111. 270017).

Nishimasu, H., et al., "Structures and mechanisms of CRISPR RNA-guided effector nucleases," Current Opinion in Structural Biology 43:68-78 (Apr. 2017; doi: 10.1016/j.sbi.2016.11.013. Epub Nov. 30, 2016).

Plagens, A., et al., "In vitro assembly and activity of an archaeal CRISPR-Cas type I-A Cascade interference complex," Nucleic Acids Research 42(8):5125-5138 (2014; doi:10.1093/nar/gku120).

Rath, D., et al., "The CRISPR-Cas immune system: biology, mechanisms and applications," Biochimie 117:119-28 (Oct. 2015; doi: 10.1016/j.biochi.2015.03.025. Epub Apr. 10, 2015).

Redding, S., et al., "Surveillance and Processing of Foreign DNA by the *Escherichia coli* CRISPR-Cas System," Cell 163(4):854-865 (Nov. 5, 2015; doi: 10.1016/j.cell.2015.10.003).

Sashital, D., et al., "Mechanism of foreign DNA selection in a bacterial adaptive immune system," Mol. Cell. 46(5):606-15 (Jun. 8, 2012; doi: 10.1016/j.molcel.2012.03.020. Epub Apr. 19, 2012).

Sinkunas, T., et al., "Cas3 is a single-stranded Dna nuclease and Atp-dependent helicase in the Crispr/Cas immune system," Embo J. 30(7):1335-1342 (Apr. 6, 2011; doi: 10.1038/emboj.2011.41; Epub Feb. 22, 2011).

Sinkunas, T., et al., "In vitro reconstitution of Cascade-mediated CRISPR immunity in *Streptococcus* thermophilus," EMBO J. 32(3):385-394 (Feb. 6, 2013; doi: 10.1038/emboj.2012.352; Epub Jan. 18, 2013).

Sorek, R., et al., "CRISPR-Mediated Adaptive Immune Systems in Bacteria and Archaea," Annu. Rev. Biochem. 82:237-266 (2013; doi: 10.1146/annurev-biochem-072911-172315, Epub Mar. 11, 2013).

Staals, R., et al., "Structure and activity of the RNA-targeting Type III-B CRISPR-Cas complex of Thermus thermophilus," Molecular cell 52(1):135-145 (2013; doi:10.1016/j.molcel.2013.09.013).

Van der Oost, J., et al., "CRISPR-based adaptive and heritable immunity in prokaryotes," Trends in Biochemical Sciences 34(8):401-407 (2009; doi:10.1016/tibs.2009.05.002; Jul. 29, 2009).

Venclovas, Č., et al., "Structure of Csm2 elucidates the relationship between small subunits of CRISPR-Cas effector complexes," FEBS Lett. 590(10):1521-9 (May 2016; doi: 10.1002/1873-3468.12179 Epub May 5, 2016).

Westra, E., et al., "CRISPR immunity relies on the consecutive binding and degradation of negatively supercoiled invader DNA by Cascade and Cas3," Molecular Cell 46(5):595-605 (2012; doi:10. 1016/j.molcel.2012.03.018).

Wiedenheft, B., et al., "Structures of the RNA-guided surveillance complex from a bacterial immune system," Nature 477(7365):486-489 (Sep. 21, 2011; doi: 10.1038/nature10402).

Zhao, H., et al., "Increasing the homogeneity, stability and activity of human serum albumin and interferon-$\alpha$2b fusion protein by linker engineering," Protein Expr. Purif. 61(1):73-7 (Sep. 2008; doi: 10.1016/j.pep.2008.04.013. Epub May 16, 2008).

* cited by examiner

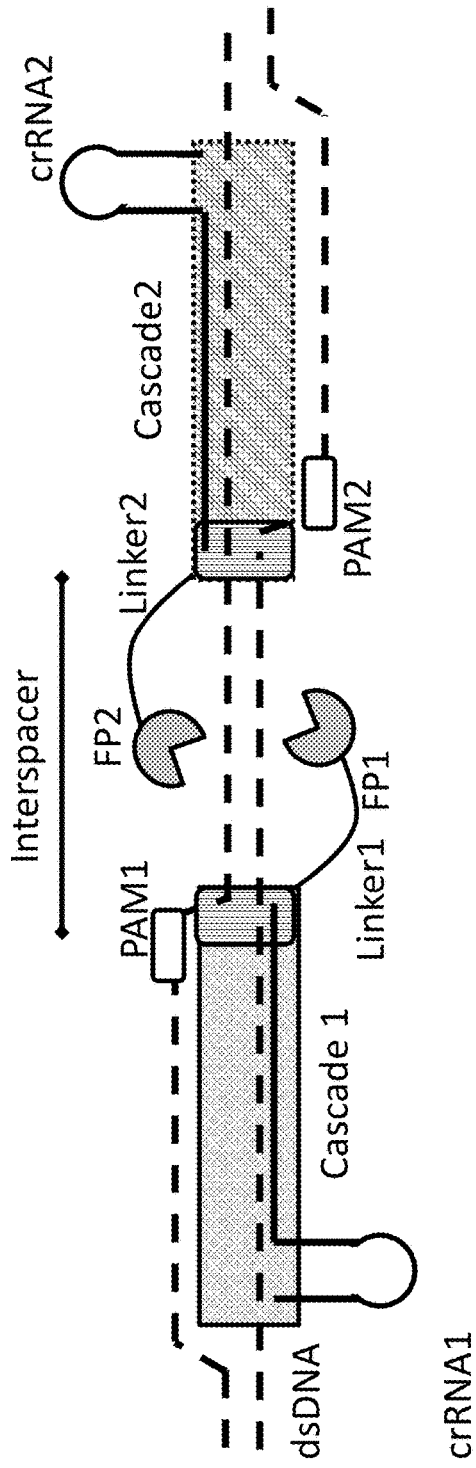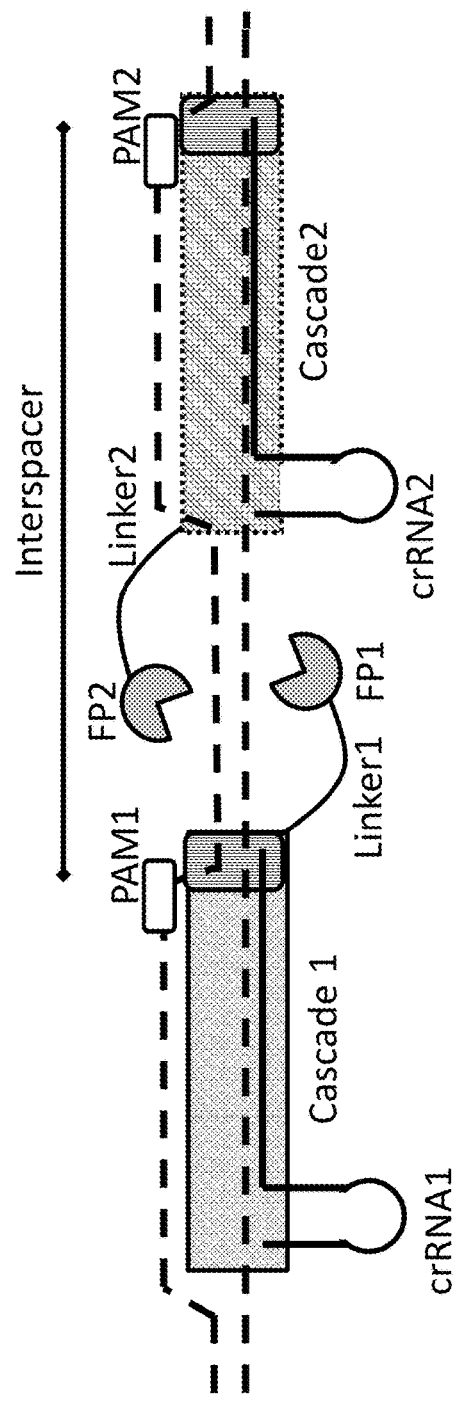
FIG. 2A
FIG. 2B

FIG. 3

| SEQ ID NO: | Gene/Protein | Subtype and organism | Type of sequence |
|---|---|---|---|
| SEQ ID NO: 1 | Cas8 | I-E_Escherichia coli K-12 MG1655 | Genomic DNA gene sequence |
| SEQ ID NO: 2 | Cse2 | I-E_Escherichia coli K-12 MG1655 | Genomic DNA gene sequence |
| SEQ ID NO: 3 | Cas7 | I-E_Escherichia coli K-12 MG1655 | Genomic DNA gene sequence |
| SEQ ID NO: 4 | Cas5 | I-E_Escherichia coli K-12 MG1655 | Genomic DNA gene sequence |
| SEQ ID NO: 5 | Cas6 | I-E_Escherichia coli K-12 MG1655 | Genomic DNA gene sequence |
| SEQ ID NO: 6 | Cas8 | I-E_Escherichia coli K-12 MG1655 | E. coli codon-optimized DNA gene sequence |
| SEQ ID NO: 7 | Cse2 | I-E_Escherichia coli K-12 MG1655 | E. coli codon-optimized DNA gene sequence |
| SEQ ID NO: 8 | Cas7 | I-E_Escherichia coli K-12 MG1655 | E. coli codon-optimized DNA gene sequence |
| SEQ ID NO: 9 | Cas5 | I-E_Escherichia coli K-12 MG1655 | E. coli codon-optimized DNA gene sequence |
| SEQ ID NO: 10 | Cas6 | I-E_Escherichia coli K-12 MG1655 | E. coli codon-optimized DNA gene sequence |
| SEQ ID NO: 11 | Cas8 | I-E_Escherichia coli K-12 MG1655 | H. sapiens codon-optimized DNA gene sequence |
| SEQ ID NO: 12 | Cse2 | I-E_Escherichia coli K-12 MG1655 | H. sapiens codon-optimized DNA gene sequence |
| SEQ ID NO: 13 | Cas7 | I-E_Escherichia coli K-12 MG1655 | H. sapiens codon-optimized DNA gene sequence |
| SEQ ID NO: 14 | Cas5 | I-E_Escherichia coli K-12 MG1655 | H. sapiens codon-optimized DNA gene sequence |
| SEQ ID NO: 15 | Cas6 | I-E_Escherichia coli K-12 MG1655 | H. sapiens codon-optimized DNA gene sequence |
| SEQ ID NO: 16 | Cas8 | I-E_Escherichia coli K-12 MG1655 | Protein amino acid sequence |
| SEQ ID NO: 17 | Cse2 | I-E_Escherichia coli K-12 MG1655 | Protein amino acid sequence |
| SEQ ID NO: 18 | Cas7 | I-E_Escherichia coli K-12 MG1655 | Protein amino acid sequence |
| SEQ ID NO: 19 | Cas5 | I-E_Escherichia coli K-12 MG1655 | Protein amino acid sequence |
| SEQ ID NO: 20 | Cas6 | I-E_Escherichia coli K-12 MG1655 | Protein amino acid sequence |
| SEQ ID NO: 21 | Cas3 | I-E_Escherichia coli K-12 MG1655 | Protein amino acid sequence |
| SEQ ID NO: 22 | Cas8 | I-E_Oceanicola sp._HL-35 | Genomic DNA gene sequence |
| SEQ ID NO: 23 | Cse2 | I-E_Oceanicola sp._HL-35 | Genomic DNA gene sequence |
| SEQ ID NO: 24 | Cas7 | I-E_Oceanicola sp._HL-35 | Genomic DNA gene sequence |

FIG. 3 (continued)

| SEQ ID NO: | Gene/ Protein | Subtype and organism | Type of sequence |
|---|---|---|---|
| SEQ ID NO: 25 | Cas5 | I-E_Oceanicola sp. HL-35 | Genomic DNA gene sequence |
| SEQ ID NO: 26 | Cas6 | I-E_Oceanicola sp. HL-35 | Genomic DNA gene sequence |
| SEQ ID NO: 27 | Cas8 | I-E_Oceanicola sp. HL-35 | H. sapiens codon-optimized DNA gene sequence |
| SEQ ID NO: 28 | Cse2 | I-E_Oceanicola sp. HL-35 | H. sapiens codon-optimized DNA gene sequence |
| SEQ ID NO: 29 | Cas7 | I-E_Oceanicola sp. HL-35 | H. sapiens codon-optimized DNA gene sequence |
| SEQ ID NO: 30 | Cas5 | I-E_Oceanicola sp. HL-35 | H. sapiens codon-optimized DNA gene sequence |
| SEQ ID NO: 31 | Cas6 | I-E_Oceanicola sp. HL-35 | H. sapiens codon-optimized DNA gene sequence |
| SEQ ID NO: 32 | Cas8 | I-E_Oceanicola sp. HL-35 | Protein amino acid sequence |
| SEQ ID NO: 33 | Cse2 | I-E_Oceanicola sp. HL-35 | Protein amino acid sequence |
| SEQ ID NO: 34 | Cas7 | I-E_Oceanicola sp. HL-35 | Protein amino acid sequence |
| SEQ ID NO: 35 | Cas5 | I-E_Oceanicola sp. HL-35 | Protein amino acid sequence |
| SEQ ID NO: 36 | Cas6 | I-E_Oceanicola sp. HL-35 | Protein amino acid sequence |
| SEQ ID NO: 37 | CRISPR | I-E_Oceanicola sp. HL-35 | Exemplary minimal CRISPR array |
| SEQ ID NO: 38 | Cas8 | I-E_Pseudomonas sp. S-6-2 | Genomic DNA gene sequence |
| SEQ ID NO: 39 | Cse2 | I-E_Pseudomonas sp. S-6-2 | Genomic DNA gene sequence |
| SEQ ID NO: 40 | Cas7 | I-E_Pseudomonas sp. S-6-2 | Genomic DNA gene sequence |
| SEQ ID NO: 41 | Cas5 | I-E_Pseudomonas sp. S-6-2 | Genomic DNA gene sequence |
| SEQ ID NO: 42 | Cas6 | I-E_Pseudomonas sp. S-6-2 | Genomic DNA gene sequence |
| SEQ ID NO: 43 | Cas8 | I-E_Pseudomonas sp. S-6-2 | H. sapiens codon-optimized DNA gene sequence |
| SEQ ID NO: 44 | Cse2 | I-E_Pseudomonas sp. S-6-2 | H. sapiens codon-optimized DNA gene sequence |
| SEQ ID NO: 45 | Cas7 | I-E_Pseudomonas sp. S-6-2 | H. sapiens codon-optimized DNA gene sequence |
| SEQ ID NO: 46 | Cas5 | I-E_Pseudomonas sp. S-6-2 | H. sapiens codon-optimized DNA gene sequence |
| SEQ ID NO: 47 | Cas6 | I-E_Pseudomonas sp. S-6-2 | H. sapiens codon-optimized DNA gene sequence |
| SEQ ID NO: 48 | Cas8 | I-E_Pseudomonas sp. S-6-2 | Protein amino acid sequence |

FIG. 3 (continued)

| SEQ ID NO: | Gene/ Protein | Subtype and organism | Type of sequence |
|---|---|---|---|
| SEQ ID NO: 49 | Cse2 | I-E_Pseudomonas sp. S-6-2 | Protein amino acid sequence |
| SEQ ID NO: 50 | Cas7 | I-E_Pseudomonas sp. S-6-2 | Protein amino acid sequence |
| SEQ ID NO: 51 | Cas5 | I-E_Pseudomonas sp. S-6-2 | Protein amino acid sequence |
| SEQ ID NO: 52 | Cas6 | I-E_Pseudomonas sp. S-6-2 | Protein amino acid sequence |
| SEQ ID NO: 53 | CRISPR | I-E_Pseudomonas sp. S-6-2 | Exemplary minimal CRISPR array |
| SEQ ID NO: 54 | Cas8 | I-E_Salmonella enterica subsp. enterica serovar Muenster strain | Genomic DNA gene sequence |
| SEQ ID NO: 55 | Cse2 | I-E_Salmonella enterica subsp. enterica serovar Muenster strain | Genomic DNA gene sequence |
| SEQ ID NO: 56 | Cas7 | I-E_Salmonella enterica subsp. enterica serovar Muenster strain | Genomic DNA gene sequence |
| SEQ ID NO: 57 | Cas5 | I-E_Salmonella enterica subsp. enterica serovar Muenster strain | Genomic DNA gene sequence |
| SEQ ID NO: 58 | Cas6 | I-E_Salmonella enterica subsp. enterica serovar Muenster strain | Genomic DNA gene sequence |
| SEQ ID NO: 59 | Cas8 | I-E_Salmonella enterica subsp. enterica serovar Muenster strain | H. sapiens codon-optimized DNA gene sequence |
| SEQ ID NO: 60 | Cse2 | I-E_Salmonella enterica subsp. enterica serovar Muenster strain | H. sapiens codon-optimized DNA gene sequence |
| SEQ ID NO: 61 | Cas7 | I-E_Salmonella enterica subsp. enterica serovar Muenster strain | H. sapiens codon-optimized DNA gene sequence |
| SEQ ID NO: 62 | Cas5 | I-E_Salmonella enterica subsp. enterica serovar Muenster strain | H. sapiens codon-optimized DNA gene sequence |
| SEQ ID NO: 63 | Cas6 | I-E_Salmonella enterica subsp. enterica serovar Muenster strain | H. sapiens codon-optimized DNA gene sequence |
| SEQ ID NO: 64 | Cas8 | I-E_Salmonella enterica subsp. enterica serovar Muenster strain | Protein amino acid sequence |
| SEQ ID NO: 65 | Cse2 | I-E_Salmonella enterica subsp. enterica serovar Muenster strain | Protein amino acid sequence |
| SEQ ID NO: 66 | Cas7 | I-E_Salmonella enterica subsp. enterica serovar Muenster strain | Protein amino acid sequence |
| SEQ ID NO: 67 | Cas5 | I-E_Salmonella enterica subsp. enterica serovar Muenster strain | Protein amino acid sequence |

FIG. 3 (continued)

| SEQ ID NO: | Gene/ Protein | Subtype and organism | Type of sequence |
|---|---|---|---|
| SEQ ID NO: 68 | Cas6 | I-E_Salmonella enterica subsp. enterica serovar Muenster strain | Protein amino acid sequence |
| SEQ ID NO: 69 | CRISPR | I-E_Salmonella enterica subsp. enterica serovar Muenster strain | Exemplary minimal CRISPR array |
| SEQ ID NO: 70 | Cas8 | I-E_Atlantibacter hermannii NBRC 105704 | Genomic DNA gene sequence |
| SEQ ID NO: 71 | Cse2 | I-E_Atlantibacter hermannii NBRC 105704 | Genomic DNA gene sequence |
| SEQ ID NO: 72 | Cas7 | I-E_Atlantibacter hermannii NBRC 105704 | Genomic DNA gene sequence |
| SEQ ID NO: 73 | Cas5 | I-E_Atlantibacter hermannii NBRC 105704 | Genomic DNA gene sequence |
| SEQ ID NO: 74 | Cas6 | I-E_Atlantibacter hermannii NBRC 105704 | Genomic DNA gene sequence |
| SEQ ID NO: 75 | Cas8 | I-E_Atlantibacter hermannii NBRC 105704 | H. sapiens codon-optimized DNA gene sequence |
| SEQ ID NO: 76 | Cse2 | I-E_Atlantibacter hermannii NBRC 105704 | H. sapiens codon-optimized DNA gene sequence |
| SEQ ID NO: 77 | Cas7 | I-E_Atlantibacter hermannii NBRC 105704 | H. sapiens codon-optimized DNA gene sequence |
| SEQ ID NO: 78 | Cas5 | I-E_Atlantibacter hermannii NBRC 105704 | H. sapiens codon-optimized DNA gene sequence |
| SEQ ID NO: 79 | Cas6 | I-E_Atlantibacter hermannii NBRC 105704 | Protein amino acid sequence |
| SEQ ID NO: 80 | Cas8 | I-E_Atlantibacter hermannii NBRC 105704 | Protein amino acid sequence |
| SEQ ID NO: 81 | Cse2 | I-E_Atlantibacter hermannii NBRC 105704 | Protein amino acid sequence |
| SEQ ID NO: 82 | Cas7 | I-E_Atlantibacter hermannii NBRC 105704 | Protein amino acid sequence |
| SEQ ID NO: 83 | Cas5 | I-E_Atlantibacter hermannii NBRC 105704 | Protein amino acid sequence |
| SEQ ID NO: 84 | Cas6 | I-E_Atlantibacter hermannii NBRC 105704 | Protein amino acid sequence |
| SEQ ID NO: 85 | CRISPR | I-E_Atlantibacter hermannii NBRC 105704 | Exemplary minimal CRISPR array |
| SEQ ID NO: 86 | Cas8 | I-E_Geothermobacter sp. EPR-M | Genomic DNA gene sequence |
| SEQ ID NO: 87 | Cse2 | I-E_Geothermobacter sp. EPR-M | Genomic DNA gene sequence |
| SEQ ID NO: 88 | Cas7 | I-E_Geothermobacter sp. EPR-M | Genomic DNA gene sequence |
| SEQ ID NO: 89 | Cas5 | I-E_Geothermobacter sp. EPR-M | Genomic DNA gene sequence |
| SEQ ID NO: 90 | Cas6 | I-E_Geothermobacter sp. EPR-M | Genomic DNA gene sequence |
| SEQ ID NO: 91 | Cas8 | I-E_Geothermobacter sp. EPR-M | H. sapiens codon-optimized DNA gene sequence |
| SEQ ID NO: 92 | Cse2 | I-E_Geothermobacter sp. EPR-M | H. sapiens codon-optimized DNA gene sequence |

FIG. 3 (continued)

| SEQ ID NO: | Gene/ Protein | Subtype and organism | Type of sequence |
|---|---|---|---|
| SEQ ID NO: 93 | Cas7 | I-E_Geothermobacter sp. EPR-M | H. sapiens codon-optimized DNA gene sequence |
| SEQ ID NO: 94 | Cas5 | I-E_Geothermobacter sp. EPR-M | H. sapiens codon-optimized DNA gene sequence |
| SEQ ID NO: 95 | Cas6 | I-E_Geothermobacter sp. EPR-M | H. sapiens codon-optimized DNA gene sequence |
| SEQ ID NO: 96 | Cas8 | I-E_Geothermobacter sp. EPR-M | Protein amino acid sequence |
| SEQ ID NO: 97 | Cse2 | I-E_Geothermobacter sp. EPR-M | Protein amino acid sequence |
| SEQ ID NO: 98 | Cas7 | I-E_Geothermobacter sp. EPR-M | Protein amino acid sequence |
| SEQ ID NO: 99 | Cas5 | I-E_Geothermobacter sp. EPR-M | Protein amino acid sequence |
| SEQ ID NO: 100 | Cas6 | I-E_Geothermobacter sp. EPR-M | Protein amino acid sequence |
| SEQ ID NO: 101 | CRISPR | I-E_Geothermobacter sp. EPR-M | Exemplary minimal CRISPR array |
| SEQ ID NO: 102 | Cas8 | I-E_Methylocaldum sp. 14B | Genomic DNA gene sequence |
| SEQ ID NO: 103 | Cse2 | I-E_Methylocaldum sp. 14B | Genomic DNA gene sequence |
| SEQ ID NO: 104 | Cas7 | I-E_Methylocaldum sp. 14B | Genomic DNA gene sequence |
| SEQ ID NO: 105 | Cas5 | I-E_Methylocaldum sp. 14B | Genomic DNA gene sequence |
| SEQ ID NO: 106 | Cas6 | I-E_Methylocaldum sp. 14B | Genomic DNA gene sequence |
| SEQ ID NO: 107 | Cas8 | I-E_Methylocaldum sp. 14B | H. sapiens codon-optimized DNA gene sequence |
| SEQ ID NO: 108 | Cse2 | I-E_Methylocaldum sp. 14B | H. sapiens codon-optimized DNA gene sequence |
| SEQ ID NO: 109 | Cas7 | I-E_Methylocaldum sp. 14B | H. sapiens codon-optimized DNA gene sequence |
| SEQ ID NO: 110 | Cas5 | I-E_Methylocaldum sp. 14B | H. sapiens codon-optimized DNA gene sequence |
| SEQ ID NO: 111 | Cas6 | I-E_Methylocaldum sp. 14B | H. sapiens codon-optimized DNA gene sequence |
| SEQ ID NO: 112 | Cas8 | I-E_Methylocaldum sp. 14B | Protein amino acid sequence |
| SEQ ID NO: 113 | Cse2 | I-E_Methylocaldum sp. 14B | Protein amino acid sequence |
| SEQ ID NO: 114 | Cas7 | I-E_Methylocaldum sp. 14B | Protein amino acid sequence |
| SEQ ID NO: 115 | Cas5 | I-E_Methylocaldum sp. 14B | Protein amino acid sequence |
| SEQ ID NO: 116 | Cas6 | I-E_Methylocaldum sp. 14B | Protein amino acid sequence |
| SEQ ID NO: 117 | CRISPR | I-E_Methylocaldum sp. 14B | Exemplary minimal CRISPR array |
| SEQ ID NO: 118 | Cas8 | I-E_Methanocella arvoryzae MRE50 | Genomic DNA gene sequence |

FIG. 3 (continued)

| SEQ ID NO: | Gene/ Protein | Subtype and organism | Type of sequence |
|---|---|---|---|
| SEQ ID NO: 119 | Cse2 | I-E_Methanocella arvoryzae MRE50 | Genomic DNA gene sequence |
| SEQ ID NO: 120 | Cas7 | I-E_Methanocella arvoryzae MRE50 | Genomic DNA gene sequence |
| SEQ ID NO: 121 | Cas5 | I-E_Methanocella arvoryzae MRE50 | Genomic DNA gene sequence |
| SEQ ID NO: 122 | Cas6 | I-E_Methanocella arvoryzae MRE50 | Genomic DNA gene sequence |
| SEQ ID NO: 123 | Cas8 | I-E_Methanocella arvoryzae MRE50 | H. sapiens codon-optimized DNA gene sequence |
| SEQ ID NO: 124 | Cse2 | I-E_Methanocella arvoryzae MRE50 | H. sapiens codon-optimized DNA gene sequence |
| SEQ ID NO: 125 | Cas7 | I-E_Methanocella arvoryzae MRE50 | H. sapiens codon-optimized DNA gene sequence |
| SEQ ID NO: 126 | Cas5 | I-E_Methanocella arvoryzae MRE50 | H. sapiens codon-optimized DNA gene sequence |
| SEQ ID NO: 127 | Cas6 | I-E_Methanocella arvoryzae MRE50 | H. sapiens codon-optimized DNA gene sequence |
| SEQ ID NO: 128 | Cas8 | I-E_Methanocella arvoryzae MRE50 | Protein amino acid sequence |
| SEQ ID NO: 129 | Cse2 | I-E_Methanocella arvoryzae MRE50 | Protein amino acid sequence |
| SEQ ID NO: 130 | Cas7 | I-E_Methanocella arvoryzae MRE50 | Protein amino acid sequence |
| SEQ ID NO: 131 | Cas5 | I-E_Methanocella arvoryzae MRE50 | Protein amino acid sequence |
| SEQ ID NO: 132 | Cas6 | I-E_Methanocella arvoryzae MRE50 | Protein amino acid sequence |
| SEQ ID NO: 133 | CRISPR | I-E_Methanocella arvoryzae MRE50 | Exemplary minimal CRISPR array |
| SEQ ID NO: 134 | Cas8 | I-E_Lachnospiraceae bacterium KH1T2 | Genomic DNA gene sequence |
| SEQ ID NO: 135 | Cse2 | I-E_Lachnospiraceae bacterium KH1T2 | Genomic DNA gene sequence |
| SEQ ID NO: 136 | Cas7 | I-E_Lachnospiraceae bacterium KH1T2 | Genomic DNA gene sequence |
| SEQ ID NO: 137 | Cas5 | I-E_Lachnospiraceae bacterium KH1T2 | Genomic DNA gene sequence |
| SEQ ID NO: 138 | Cas6 | I-E_Lachnospiraceae bacterium KH1T2 | Genomic DNA gene sequence |
| SEQ ID NO: 139 | Cas8 | I-E_Lachnospiraceae bacterium KH1T2 | H. sapiens codon-optimized DNA gene sequence |
| SEQ ID NO: 140 | Cse2 | I-E_Lachnospiraceae bacterium KH1T2 | H. sapiens codon-optimized DNA gene sequence |
| SEQ ID NO: 141 | Cas7 | I-E_Lachnospiraceae bacterium KH1T2 | H. sapiens codon-optimized DNA gene sequence |
| SEQ ID NO: 142 | Cas5 | I-E_Lachnospiraceae bacterium KH1T2 | H. sapiens codon-optimized DNA gene sequence |

FIG. 3 (continued)

| SEQ ID NO: | Gene/ Protein | Subtype and organism | Type of sequence |
|---|---|---|---|
| SEQ ID NO: 143 | Cas6 | I-E_Lachnospiraceae bacterium KH1T2 | H. sapiens codon-optimized DNA gene sequence |
| SEQ ID NO: 144 | Cas8 | I-E_Lachnospiraceae bacterium KH1T2 | Protein amino acid sequence |
| SEQ ID NO: 145 | Cse2 | I-E_Lachnospiraceae bacterium KH1T2 | Protein amino acid sequence |
| SEQ ID NO: 146 | Cas7 | I-E_Lachnospiraceae bacterium KH1T2 | Protein amino acid sequence |
| SEQ ID NO: 147 | Cas5 | I-E_Lachnospiraceae bacterium KH1T2 | Protein amino acid sequence |
| SEQ ID NO: 148 | Cas6 | I-E_Lachnospiraceae bacterium KH1T2 | Protein amino acid sequence |
| SEQ ID NO: 149 | CRISPR | I-E_Lachnospiraceae bacterium KH1T2 | Exemplary minimal CRISPR array |
| SEQ ID NO: 150 | Cas8 | I-E_Klebsiella pneumoniae strain VRCO0172 | Genomic DNA gene sequence |
| SEQ ID NO: 151 | Cse2 | I-E_Klebsiella pneumoniae strain VRCO0172 | Genomic DNA gene sequence |
| SEQ ID NO: 152 | Cas7 | I-E_Klebsiella pneumoniae strain VRCO0172 | Genomic DNA gene sequence |
| SEQ ID NO: 153 | Cas5 | I-E_Klebsiella pneumoniae strain VRCO0172 | Genomic DNA gene sequence |
| SEQ ID NO: 154 | Cas6 | I-E_Klebsiella pneumoniae strain VRCO0172 | Genomic DNA gene sequence |
| SEQ ID NO: 155 | Cas8 | I-E_Klebsiella pneumoniae strain VRCO0172 | H. sapiens codon-optimized DNA gene sequence |
| SEQ ID NO: 156 | Cse2 | I-E_Klebsiella pneumoniae strain VRCO0172 | H. sapiens codon-optimized DNA gene sequence |
| SEQ ID NO: 157 | Cas7 | I-E_Klebsiella pneumoniae strain VRCO0172 | H. sapiens codon-optimized DNA gene sequence |
| SEQ ID NO: 158 | Cas5 | I-E_Klebsiella pneumoniae strain VRCO0172 | H. sapiens codon-optimized DNA gene sequence |
| SEQ ID NO: 159 | Cas6 | I-E_Klebsiella pneumoniae strain VRCO0172 | H. sapiens codon-optimized DNA gene sequence |
| SEQ ID NO: 160 | Cas8 | I-E_Klebsiella pneumoniae strain VRCO0172 | Protein amino acid sequence |
| SEQ ID NO: 161 | Cse2 | I-E_Klebsiella pneumoniae strain VRCO0172 | Protein amino acid sequence |
| SEQ ID NO: 162 | Cas7 | I-E_Klebsiella pneumoniae strain VRCO0172 | Protein amino acid sequence |
| SEQ ID NO: 163 | Cas5 | I-E_Klebsiella pneumoniae strain VRCO0172 | Protein amino acid sequence |
| SEQ ID NO: 164 | Cas6 | I-E_Klebsiella pneumoniae strain VRCO0172 | Protein amino acid sequence |
| SEQ ID NO: 165 | CRISPR | I-E_Klebsiella pneumoniae strain VRCO0172 | Exemplary minimal CRISPR array |
| SEQ ID NO: 166 | Cas8 | I-E_Pseudomonas aeruginosa DHS01 | Genomic DNA gene sequence |
| SEQ ID NO: 167 | Cse2 | I-E_Pseudomonas aeruginosa DHS01 | Genomic DNA gene sequence |
| SEQ ID NO: 168 | Cas7 | I-E_Pseudomonas aeruginosa DHS01 | Genomic DNA gene sequence |
| SEQ ID NO: 169 | Cas5 | I-E_Pseudomonas aeruginosa DHS01 | Genomic DNA gene sequence |
| SEQ ID NO: 170 | Cas6 | I-E_Pseudomonas aeruginosa DHS01 | Genomic DNA gene sequence |

FIG. 3 (continued)

| SEQ ID NO: | Gene/Protein | Subtype and organism | Type of sequence |
|---|---|---|---|
| SEQ ID NO: 171 | Cas8 | I-E_Pseudomonas aeruginosa DHS01 | H. sapiens codon-optimized DNA gene sequence |
| SEQ ID NO: 172 | Cse2 | I-E_Pseudomonas aeruginosa DHS01 | H. sapiens codon-optimized DNA gene sequence |
| SEQ ID NO: 173 | Cas7 | I-E_Pseudomonas aeruginosa DHS01 | H. sapiens codon-optimized DNA gene sequence |
| SEQ ID NO: 174 | Cas5 | I-E_Pseudomonas aeruginosa DHS01 | H. sapiens codon-optimized DNA gene sequence |
| SEQ ID NO: 175 | Cas6 | I-E_Pseudomonas aeruginosa DHS01 | H. sapiens codon-optimized DNA gene sequence |
| SEQ ID NO: 176 | Cas8 | I-E_Pseudomonas aeruginosa DHS01 | Protein amino acid sequence |
| SEQ ID NO: 177 | Cse2 | I-E_Pseudomonas aeruginosa DHS01 | Protein amino acid sequence |
| SEQ ID NO: 178 | Cas7 | I-E_Pseudomonas aeruginosa DHS01 | Protein amino acid sequence |
| SEQ ID NO: 179 | Cas5 | I-E_Pseudomonas aeruginosa DHS01 | Protein amino acid sequence |
| SEQ ID NO: 180 | Cas6 | I-E_Pseudomonas aeruginosa DHS01 | Protein amino acid sequence |
| SEQ ID NO: 181 | CRISPR | I-E_Pseudomonas aeruginosa DHS01 | Exemplary minimal CRISPR array |
| SEQ ID NO: 182 | Cas8 | I-E_Streptococcus thermophilus strain ND07 | Genomic DNA gene sequence |
| SEQ ID NO: 183 | Cse2 | I-E_Streptococcus thermophilus strain ND07 | Genomic DNA gene sequence |
| SEQ ID NO: 184 | Cas7 | I-E_Streptococcus thermophilus strain ND07 | Genomic DNA gene sequence |
| SEQ ID NO: 185 | Cas5 | I-E_Streptococcus thermophilus strain ND07 | Genomic DNA gene sequence |
| SEQ ID NO: 186 | Cas6 | I-E_Streptococcus thermophilus strain ND07 | Genomic DNA gene sequence |
| SEQ ID NO: 187 | Cas8 | I-E_Streptococcus thermophilus strain ND07 | H. sapiens codon-optimized DNA gene sequence |
| SEQ ID NO: 188 | Cse2 | I-E_Streptococcus thermophilus strain ND07 | H. sapiens codon-optimized DNA gene sequence |
| SEQ ID NO: 189 | Cas7 | I-E_Streptococcus thermophilus strain ND07 | H. sapiens codon-optimized DNA gene sequence |
| SEQ ID NO: 190 | Cas5 | I-E_Streptococcus thermophilus strain ND07 | H. sapiens codon-optimized DNA gene sequence |
| SEQ ID NO: 191 | Cas6 | I-E_Streptococcus thermophilus strain ND07 | H. sapiens codon-optimized DNA gene sequence |
| SEQ ID NO: 192 | Cas8 | I-E_Streptococcus thermophilus strain ND07 | Protein amino acid sequence |
| SEQ ID NO: 193 | Cse2 | I-E_Streptococcus thermophilus strain ND07 | Protein amino acid sequence |
| SEQ ID NO: 194 | Cas7 | I-E_Streptococcus thermophilus strain ND07 | Protein amino acid sequence |

FIG. 3 (continued)

| SEQ ID NO: | Gene/Protein | Subtype and organism | Type of sequence |
|---|---|---|---|
| SEQ ID NO: 195 | Cas5 | I-E_Streptococcus thermophilus strain ND07 | Protein amino acid sequence |
| SEQ ID NO: 196 | Cas6 | I-E_Streptococcus thermophilus strain ND07 | Protein amino acid sequence |
| SEQ ID NO: 197 | CRISPR | I-E_Streptococcus thermophilus strain ND07 | Exemplary minimal CRISPR array |
| SEQ ID NO: 198 | Cas8 | I-E_Streptomyces sp. S4 | Genomic DNA gene sequence |
| SEQ ID NO: 199 | Cse2 | I-E_Streptomyces sp. S4 | Genomic DNA gene sequence |
| SEQ ID NO: 200 | Cas7 | I-E_Streptomyces sp. S4 | Genomic DNA gene sequence |
| SEQ ID NO: 201 | Cas5 | I-E_Streptomyces sp. S4 | Genomic DNA gene sequence |
| SEQ ID NO: 202 | Cas6 | I-E_Streptomyces sp. S4 | Genomic DNA gene sequence |
| SEQ ID NO: 203 | Cas8 | I-E_Streptomyces sp. S4 | H. sapiens codon-optimized DNA gene sequence |
| SEQ ID NO: 204 | Cse2 | I-E_Streptomyces sp. S4 | H. sapiens codon-optimized DNA gene sequence |
| SEQ ID NO: 205 | Cas7 | I-E_Streptomyces sp. S4 | H. sapiens codon-optimized DNA gene sequence |
| SEQ ID NO: 206 | Cas5 | I-E_Streptomyces sp. S4 | H. sapiens codon-optimized DNA gene sequence |
| SEQ ID NO: 207 | Cas6 | I-E_Streptomyces sp. S4 | H. sapiens codon-optimized DNA gene sequence |
| SEQ ID NO: 208 | Cas8 | I-E_Streptomyces sp. S4 | Protein amino acid sequence |
| SEQ ID NO: 209 | Cse2 | I-E_Streptomyces sp. S4 | Protein amino acid sequence |
| SEQ ID NO: 210 | Cas7 | I-E_Streptomyces sp. S4 | Protein amino acid sequence |
| SEQ ID NO: 211 | Cas5 | I-E_Streptomyces sp. S4 | Protein amino acid sequence |
| SEQ ID NO: 212 | Cas6 | I-E_Streptomyces sp. S4 | Protein amino acid sequence |
| SEQ ID NO: 213 | CRISPR | I-E_Streptomyces sp. S4 | Exemplary minimal CRISPR array |
| SEQ ID NO: 214 | Cas6 | I-B_Fusobacterium nucleatum subsp. animalis 3_1_33 | Genomic DNA gene sequence |
| SEQ ID NO: 215 | Cas8 | I-B_Fusobacterium nucleatum subsp. animalis 3_1_33 | Genomic DNA gene sequence |
| SEQ ID NO: 216 | Cas7 | I-B_Fusobacterium nucleatum subsp. animalis 3_1_33 | Genomic DNA gene sequence |
| SEQ ID NO: 217 | Cas5 | I-B_Fusobacterium nucleatum subsp. animalis 3_1_33 | Genomic DNA gene sequence |
| SEQ ID NO: 218 | Cas6 | I-B_Fusobacterium nucleatum subsp. animalis 3_1_33 | H. sapiens codon-optimized DNA gene sequence |

FIG. 3 (continued)

| SEQ ID NO: | Gene/ Protein | Subtype and organism | Type of sequence |
|---|---|---|---|
| SEQ ID NO: 219 | Cas8 | I-B_Fusobacterium nucleatum subsp. animalis 3_1_33 | H. sapiens codon-optimized DNA gene sequence |
| SEQ ID NO: 220 | Cas7 | I-B_Fusobacterium nucleatum subsp. animalis 3_1_33 | H. sapiens codon-optimized DNA gene sequence |
| SEQ ID NO: 221 | Cas5 | I-B_Fusobacterium nucleatum subsp. animalis 3_1_33 | H. sapiens codon-optimized DNA gene sequence |
| SEQ ID NO: 222 | Cas6 | I-B_Fusobacterium nucleatum subsp. animalis 3_1_33 | Protein amino acid sequence |
| SEQ ID NO: 223 | Cas8 | I-B_Fusobacterium nucleatum subsp. animalis 3_1_33 | Protein amino acid sequence |
| SEQ ID NO: 224 | Cas7 | I-B_Fusobacterium nucleatum subsp. animalis 3_1_33 | Protein amino acid sequence |
| SEQ ID NO: 225 | Cas5 | I-B_Fusobacterium nucleatum subsp. animalis 3_1_33 | Protein amino acid sequence |
| SEQ ID NO: 226 | CRISPR | I-B_Fusobacterium nucleatum subsp. animalis 3_1_33 | Exemplary minimal CRISPR array |
| SEQ ID NO: 227 | Cas6 | I-B_Campylobacter fetus subsp. testudinum Sp3 | Genomic DNA gene sequence |
| SEQ ID NO: 228 | Cas8 | I-B_Campylobacter fetus subsp. testudinum Sp3 | Genomic DNA gene sequence |
| SEQ ID NO: 229 | Cas7 | I-B_Campylobacter fetus subsp. testudinum Sp3 | Genomic DNA gene sequence |
| SEQ ID NO: 230 | Cas5 | I-B_Campylobacter fetus subsp. testudinum Sp3 | Genomic DNA gene sequence |
| SEQ ID NO: 231 | Cas6 | I-B_Campylobacter fetus subsp. testudinum Sp3 | H. sapiens codon-optimized DNA gene sequence |
| SEQ ID NO: 232 | Cas8 | I-B_Campylobacter fetus subsp. testudinum Sp3 | H. sapiens codon-optimized DNA gene sequence |
| SEQ ID NO: 233 | Cas7 | I-B_Campylobacter fetus subsp. testudinum Sp3 | H. sapiens codon-optimized DNA gene sequence |
| SEQ ID NO: 234 | Cas5 | I-B_Campylobacter fetus subsp. testudinum Sp3 | H. sapiens codon-optimized DNA gene sequence |
| SEQ ID NO: 235 | Cas6 | I-B_Campylobacter fetus subsp. testudinum Sp3 | Protein amino acid sequence |
| SEQ ID NO: 236 | Cas8 | I-B_Campylobacter fetus subsp. testudinum Sp3 | Protein amino acid sequence |
| SEQ ID NO: 237 | Cas7 | I-B_Campylobacter fetus subsp. testudinum Sp3 | Protein amino acid sequence |
| SEQ ID NO: 238 | Cas5 | I-B_Campylobacter fetus subsp. testudinum Sp3 | Protein amino acid sequence |
| SEQ ID NO: 239 | CRISPR | I-B_Campylobacter fetus subsp. testudinum Sp3 | Exemplary minimal CRISPR array |
| SEQ ID NO: 240 | Cas6 | I-B_Odoribacter splanchnicus DSM 20712 | Genomic DNA gene sequence |

FIG. 3 (continued)

| SEQ ID NO: | Gene/ Protein | Subtype and organism | Type of sequence |
|---|---|---|---|
| SEQ ID NO: 241 | Cas8 | I-B_Odoribacter splanchnicus DSM 20712 | Genomic DNA gene sequence |
| SEQ ID NO: 242 | Cas7 | I-B_Odoribacter splanchnicus DSM 20712 | Genomic DNA gene sequence |
| SEQ ID NO: 243 | Cas5 | I-B_Odoribacter splanchnicus DSM 20712 | Genomic DNA gene sequence |
| SEQ ID NO: 244 | Cas6 | I-B_Odoribacter splanchnicus DSM 20712 | H. sapiens codon-optimized DNA gene sequence |
| SEQ ID NO: 245 | Cas8 | I-B_Odoribacter splanchnicus DSM 20712 | H. sapiens codon-optimized DNA gene sequence |
| SEQ ID NO: 246 | Cas7 | I-B_Odoribacter splanchnicus DSM 20712 | H. sapiens codon-optimized DNA gene sequence |
| SEQ ID NO: 247 | Cas5 | I-B_Odoribacter splanchnicus DSM 20712 | H. sapiens codon-optimized DNA gene sequence |
| SEQ ID NO: 248 | Cas6 | I-B_Odoribacter splanchnicus DSM 20712 | Protein amino acid sequence |
| SEQ ID NO: 249 | Cas8 | I-B_Odoribacter splanchnicus DSM 20712 | Protein amino acid sequence |
| SEQ ID NO: 250 | Cas7 | I-B_Odoribacter splanchnicus DSM 20712 | Protein amino acid sequence |
| SEQ ID NO: 251 | Cas5 | I-B_Odoribacter splanchnicus DSM 20712 | Protein amino acid sequence |
| SEQ ID NO: 252 | CRISPR | I-B_Odoribacter splanchnicus DSM 20712 | Exemplary minimal CRISPR array |
| SEQ ID NO: 253 | Cas5 | I-C_Bacillus halodurans C-125 | Genomic DNA gene sequence |
| SEQ ID NO: 254 | Cas8 | I-C_Bacillus halodurans C-125 | Genomic DNA gene sequence |
| SEQ ID NO: 255 | Cas7 | I-C_Bacillus halodurans C-125 | Genomic DNA gene sequence |
| SEQ ID NO: 256 | Cas5 | I-C_Bacillus halodurans C-125 | H. sapiens codon-optimized DNA gene sequence |
| SEQ ID NO: 257 | Cas8 | I-C_Bacillus halodurans C-125 | H. sapiens codon-optimized DNA gene sequence |
| SEQ ID NO: 258 | Cas7 | I-C_Bacillus halodurans C-125 | H. sapiens codon-optimized DNA gene sequence |
| SEQ ID NO: 259 | Cas5 | I-C_Bacillus halodurans C-125 | Protein amino acid sequence |
| SEQ ID NO: 260 | Cas8 | I-C_Bacillus halodurans C-125 | Protein amino acid sequence |
| SEQ ID NO: 261 | Cas7 | I-C_Bacillus halodurans C-125 | Protein amino acid sequence |
| SEQ ID NO: 262 | CRISPR | I-C_Bacillus halodurans C-125 | Exemplary minimal CRISPR array |
| SEQ ID NO: 263 | Cas5 | I-C_Desulfovibrio vulgaris RCH1 plasmid pDEVAL01 | Genomic DNA gene sequence |
| SEQ ID NO: 264 | Cas8 | I-C_Desulfovibrio vulgaris RCH1 plasmid pDEVAL01 | Genomic DNA gene sequence |

FIG. 3 (continued)

| SEQ ID NO: | Gene/ Protein | Subtype and organism | Type of sequence |
|---|---|---|---|
| SEQ ID NO: 265 | Cas7 | I-C_Desulfovibrio vulgaris RCH1 plasmid pDEVAL01 | Genomic DNA gene sequence |
| SEQ ID NO: 266 | Cas5 | I-C_Desulfovibrio vulgaris RCH1 plasmid pDEVAL01 | H. sapiens codon-optimized DNA gene sequence |
| SEQ ID NO: 267 | Cas8 | I-C_Desulfovibrio vulgaris RCH1 plasmid pDEVAL01 | H. sapiens codon-optimized DNA gene sequence |
| SEQ ID NO: 268 | Cas7 | I-C_Desulfovibrio vulgaris RCH1 plasmid pDEVAL01 | H. sapiens codon-optimized DNA gene sequence |
| SEQ ID NO: 269 | Cas5 | I-C_Desulfovibrio vulgaris RCH1 plasmid pDEVAL01 | Protein amino acid sequence |
| SEQ ID NO: 270 | Cas8 | I-C_Desulfovibrio vulgaris RCH1 plasmid pDEVAL01 | Protein amino acid sequence |
| SEQ ID NO: 271 | Cas7 | I-C_Desulfovibrio vulgaris RCH1 plasmid pDEVAL01 | Protein amino acid sequence |
| SEQ ID NO: 272 | CRISPR | I-C_Desulfovibrio vulgaris RCH1 plasmid pDEVAL01 | Exemplary minimal CRISPR array |
| SEQ ID NO: 273 | Cas5 | I-C_Geobacillus thermocatenulatus strain KCTC 3921 | Genomic DNA gene sequence |
| SEQ ID NO: 274 | Cas8 | I-C_Geobacillus thermocatenulatus strain KCTC 3921 | Genomic DNA gene sequence |
| SEQ ID NO: 275 | Cas7 | I-C_Geobacillus thermocatenulatus strain KCTC 3921 | Genomic DNA gene sequence |
| SEQ ID NO: 276 | Cas5 | I-C_Geobacillus thermocatenulatus strain KCTC 3921 | H. sapiens codon-optimized DNA gene sequence |
| SEQ ID NO: 277 | Cas8 | I-C_Geobacillus thermocatenulatus strain KCTC 3921 | H. sapiens codon-optimized DNA gene sequence |
| SEQ ID NO: 278 | Cas7 | I-C_Geobacillus thermocatenulatus strain KCTC 3921 | H. sapiens codon-optimized DNA gene sequence |
| SEQ ID NO: 279 | Cas5 | I-C_Geobacillus thermocatenulatus strain KCTC 3921 | Protein amino acid sequence |
| SEQ ID NO: 280 | Cas8 | I-C_Geobacillus thermocatenulatus strain KCTC 3921 | Protein amino acid sequence |
| SEQ ID NO: 281 | Cas7 | I-C_Geobacillus thermocatenulatus strain KCTC 3921 | Protein amino acid sequence |

FIG. 3 (continued)

| SEQ ID NO: | Gene/ Protein | Subtype and organism | Type of sequence |
|---|---|---|---|
| SEQ ID NO: 282 | CRISPR | 1-C_Geobacillus thermocatenulatus strain KCTC 3921 | Exemplary minimal CRISPR array |
| SEQ ID NO: 283 | Cas8 | I-F_Vibrio cholerae strain L15 | Genomic DNA gene sequence |
| SEQ ID NO: 284 | Cas5 | I-F_Vibrio cholerae strain L15 | Genomic DNA gene sequence |
| SEQ ID NO: 285 | Cas7 | I-F_Vibrio cholerae strain L15 | Genomic DNA gene sequence |
| SEQ ID NO: 286 | Cas6 | I-F_Vibrio cholerae strain L15 | Genomic DNA gene sequence |
| SEQ ID NO: 287 | Cas8 | I-F_Vibrio cholerae strain L15 | H. sapiens codon-optimized DNA gene sequence |
| SEQ ID NO: 288 | Cas5 | I-F_Vibrio cholerae strain L15 | H. sapiens codon-optimized DNA gene sequence |
| SEQ ID NO: 289 | Cas7 | I-F_Vibrio cholerae strain L15 | H. sapiens codon-optimized DNA gene sequence |
| SEQ ID NO: 290 | Cas6 | I-F_Vibrio cholerae strain L15 | H. sapiens codon-optimized DNA gene sequence |
| SEQ ID NO: 291 | Cas8 | I-F_Vibrio cholerae strain L15 | Protein amino acid sequence |
| SEQ ID NO: 292 | Cas5 | I-F_Vibrio cholerae strain L15 | Protein amino acid sequence |
| SEQ ID NO: 293 | Cas7 | I-F_Vibrio cholerae strain L15 | Protein amino acid sequence |
| SEQ ID NO: 294 | Cas6 | I-F_Vibrio cholerae strain L15 | Protein amino acid sequence |
| SEQ ID NO: 295 | CRISPR | I-F_Vibrio cholerae strain L15 | Exemplary minimal CRISPR array |
| SEQ ID NO: 296 | Cas8 | I-F_Klebsiella oxytoca strain ICU1-2b | Genomic DNA gene sequence |
| SEQ ID NO: 297 | Cas5 | I-F_Klebsiella oxytoca strain ICU1-2b | Genomic DNA gene sequence |
| SEQ ID NO: 298 | Cas7 | I-F_Klebsiella oxytoca strain ICU1-2b | Genomic DNA gene sequence |
| SEQ ID NO: 299 | Cas6 | I-F_Klebsiella oxytoca strain ICU1-2b | Genomic DNA gene sequence |
| SEQ ID NO: 300 | Cas8 | I-F_Klebsiella oxytoca strain ICU1-2b | H. sapiens codon-optimized DNA gene sequence |
| SEQ ID NO: 301 | Cas5 | I-F_Klebsiella oxytoca strain ICU1-2b | H. sapiens codon-optimized DNA gene sequence |
| SEQ ID NO: 302 | Cas7 | I-F_Klebsiella oxytoca strain ICU1-2b | H. sapiens codon-optimized DNA gene sequence |
| SEQ ID NO: 303 | Cas6 | I-F_Klebsiella oxytoca strain ICU1-2b | H. sapiens codon-optimized DNA gene sequence |
| SEQ ID NO: 304 | Cas8 | I-F_Klebsiella oxytoca strain ICU1-2b | Protein amino acid sequence |
| SEQ ID NO: 305 | Cas5 | I-F_Klebsiella oxytoca strain ICU1-2b | Protein amino acid sequence |
| SEQ ID NO: 306 | Cas7 | I-F_Klebsiella oxytoca strain ICU1-2b | Protein amino acid sequence |

FIG. 3 (continued)

| SEQ ID NO: | Gene/ Protein | Subtype and organism | Type of sequence |
|---|---|---|---|
| SEQ ID NO: 307 | Cas6 | I-F_Klebsiella oxytoca strain ICU1-2b | Protein amino acid sequence |
| SEQ ID NO: 308 | CRISPR | I-F_Klebsiella oxytoca strain ICU1-2b | Exemplary minimal CRISPR array |
| SEQ ID NO: 309 | Cas8 | I-F_Pseudomonas aeruginosa UCBPP-PA14 | Genomic DNA gene sequence |
| SEQ ID NO: 310 | Cas5 | I-F_Pseudomonas aeruginosa UCBPP-PA14 | Genomic DNA gene sequence |
| SEQ ID NO: 311 | Cas7 | I-F_Pseudomonas aeruginosa UCBPP-PA14 | Genomic DNA gene sequence |
| SEQ ID NO: 312 | Cas6 | I-F_Pseudomonas aeruginosa UCBPP-PA14 | Genomic DNA gene sequence |
| SEQ ID NO: 313 | Cas8 | I-F_Pseudomonas aeruginosa UCBPP-PA14 | H. sapiens codon-optimized DNA gene sequence |
| SEQ ID NO: 314 | Cas5 | I-F_Pseudomonas aeruginosa UCBPP-PA14 | H. sapiens codon-optimized DNA gene sequence |
| SEQ ID NO: 315 | Cas7 | I-F_Pseudomonas aeruginosa UCBPP-PA14 | H. sapiens codon-optimized DNA gene sequence |
| SEQ ID NO: 316 | Cas6 | I-F_Pseudomonas aeruginosa UCBPP-PA14 | H. sapiens codon-optimized DNA gene sequence |
| SEQ ID NO: 317 | Cas8 | I-F_Pseudomonas aeruginosa UCBPP-PA14 | Protein amino acid sequence |
| SEQ ID NO: 318 | Cas5 | I-F_Pseudomonas aeruginosa UCBPP-PA14 | Protein amino acid sequence |
| SEQ ID NO: 319 | Cas7 | I-F_Pseudomonas aeruginosa UCBPP-PA14 | Protein amino acid sequence |
| SEQ ID NO: 320 | Cas6 | I-F_Pseudomonas aeruginosa UCBPP-PA14 | Protein amino acid sequence |
| SEQ ID NO: 321 | CRISPR | I-F_Pseudomonas aeruginosa UCBPP-PA14 | Exemplary minimal CRISPR array |
| SEQ ID NO: 322 | Cas7 | I-Fv2_Shewanella putrefaciens CN-32 | Genomic DNA gene sequence |
| SEQ ID NO: 323 | Cas5 | I-Fv2_Shewanella putrefaciens CN-32 | Genomic DNA gene sequence |
| SEQ ID NO: 324 | Cas6 | I-Fv2_Shewanella putrefaciens CN-32 | Genomic DNA gene sequence |
| SEQ ID NO: 325 | Cas7 | I-Fv2_Shewanella putrefaciens CN-32 | H. sapiens codon-optimized DNA gene sequence |
| SEQ ID NO: 326 | Cas5 | I-Fv2_Shewanella putrefaciens CN-32 | H. sapiens codon-optimized DNA gene sequence |
| SEQ ID NO: 327 | Cas6 | I-Fv2_Shewanella putrefaciens CN-32 | H. sapiens codon-optimized DNA gene sequence |
| SEQ ID NO: 328 | Cas7 | I-Fv2_Shewanella putrefaciens CN-32 | Protein amino acid sequence |
| SEQ ID NO: 329 | Cas5 | I-Fv2_Shewanella putrefaciens CN-32 | Protein amino acid sequence |
| SEQ ID NO: 330 | Cas6 | I-Fv2_Shewanella putrefaciens CN-32 | Protein amino acid sequence |
| SEQ ID NO: 331 | CRISPR | I-Fv2_Shewanella putrefaciens CN-32 | Exemplary minimal CRISPR array |
| SEQ ID NO: 332 | Cas7 | I-Fv2_Acinetobacter sp. 869535 | Genomic DNA gene sequence |
| SEQ ID NO: 333 | Cas5 | I-Fv2_Acinetobacter sp. 869535 | Genomic DNA gene sequence |

FIG. 3 (continued)

| SEQ ID NO: | Gene/ Protein | Subtype and organism | Type of sequence |
|---|---|---|---|
| SEQ ID NO: 334 | Cas6 | I-Fv2_Acinetobacter sp. 869535 | Genomic DNA gene sequence |
| SEQ ID NO: 335 | Cas7 | I-Fv2_Acinetobacter sp. 869535 | *H. sapiens* codon-optimized DNA gene sequence |
| SEQ ID NO: 336 | Cas5 | I-Fv2_Acinetobacter sp. 869535 | *H. sapiens* codon-optimized DNA gene sequence |
| SEQ ID NO: 337 | Cas6 | I-Fv2_Acinetobacter sp. 869535 | *H. sapiens* codon-optimized DNA gene sequence |
| SEQ ID NO: 338 | Cas7 | I-Fv2_Acinetobacter sp. 869535 | Protein amino acid sequence |
| SEQ ID NO: 339 | Cas5 | I-Fv2_Acinetobacter sp. 869535 | Protein amino acid sequence |
| SEQ ID NO: 340 | Cas6 | I-Fv2_Acinetobacter sp. 869535 | Protein amino acid sequence |
| SEQ ID NO: 341 | CRISPR | I-Fv2_Acinetobacter sp. 869535 | Exemplary minimal CRISPR array |
| SEQ ID NO: 342 | Cas7 | I-Fv2_Vibrio cholerae HE48 | Genomic DNA gene sequence |
| SEQ ID NO: 343 | Cas5 | I-Fv2_Vibrio cholerae HE48 | Genomic DNA gene sequence |
| SEQ ID NO: 344 | Cas6 | I-Fv2_Vibrio cholerae HE48 | Genomic DNA gene sequence |
| SEQ ID NO: 345 | Cas7 | I-Fv2_Vibrio cholerae HE48 | *H. sapiens* codon-optimized DNA gene sequence |
| SEQ ID NO: 346 | Cas5 | I-Fv2_Vibrio cholerae HE48 | *H. sapiens* codon-optimized DNA gene sequence |
| SEQ ID NO: 347 | Cas6 | I-Fv2_Vibrio cholerae HE48 | *H. sapiens* codon-optimized DNA gene sequence |
| SEQ ID NO: 348 | Cas7 | I-Fv2_Vibrio cholerae HE48 | Protein amino acid sequence |
| SEQ ID NO: 349 | Cas5 | I-Fv2_Vibrio cholerae HE48 | Protein amino acid sequence |
| SEQ ID NO: 350 | Cas6 | I-Fv2_Vibrio cholerae HE48 | Protein amino acid sequence |
| SEQ ID NO: 351 | CRISPR | I-Fv2_Vibrio cholerae HE48 | Exemplary minimal CRISPR array |

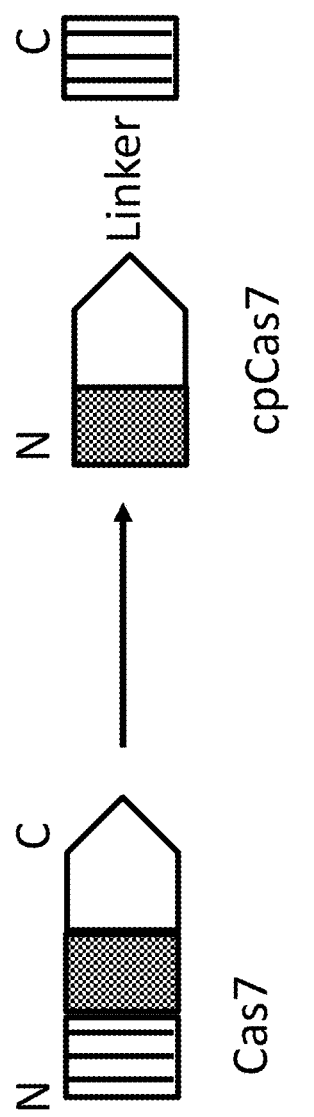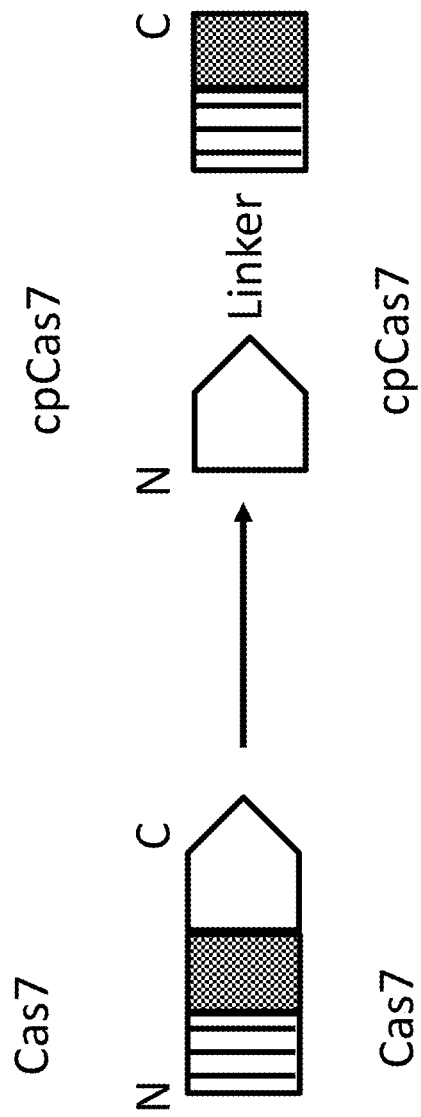
FIG. 4A
FIG. 4B

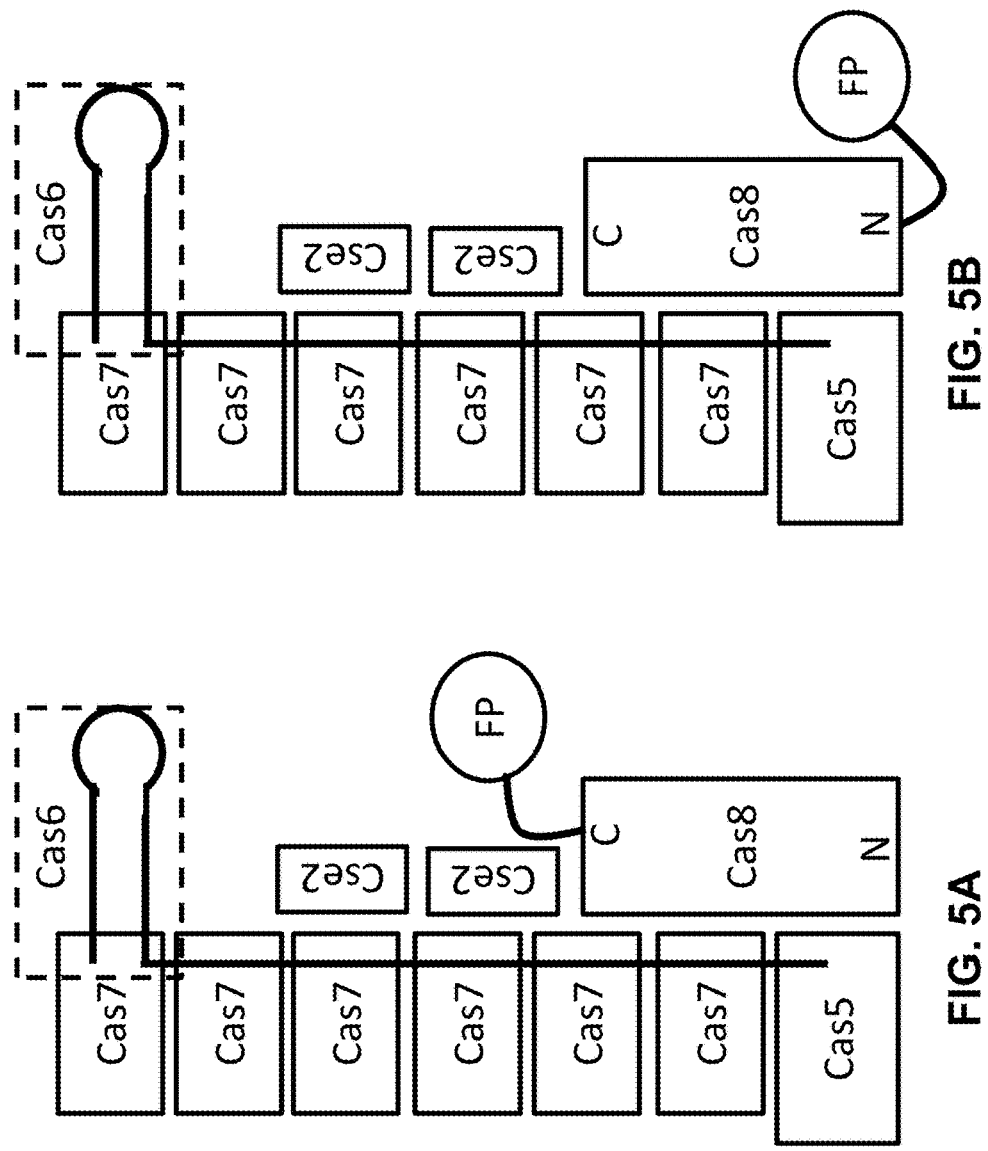

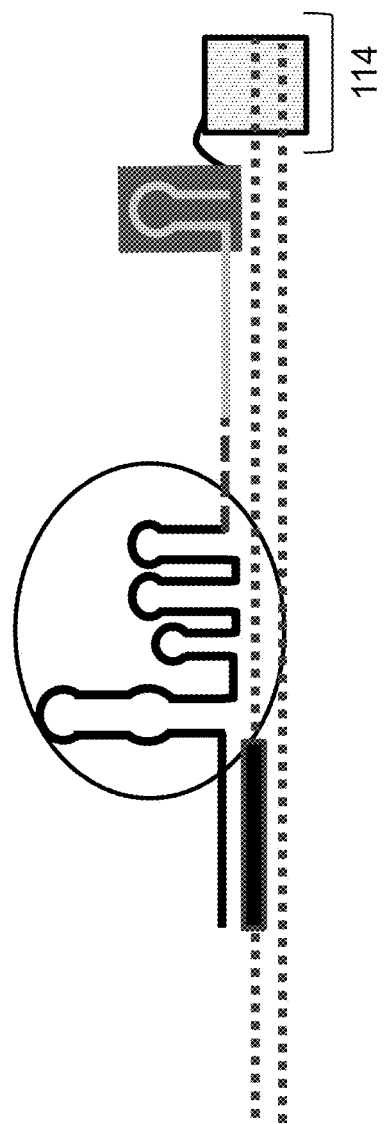

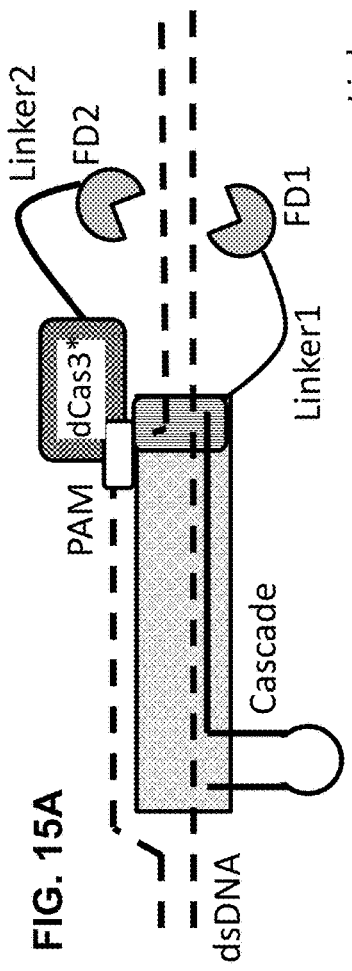
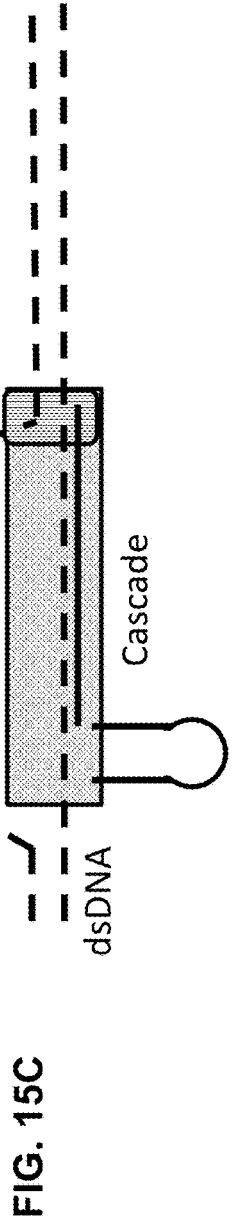
FIG. 15A
FIG. 15B
FIG. 15C

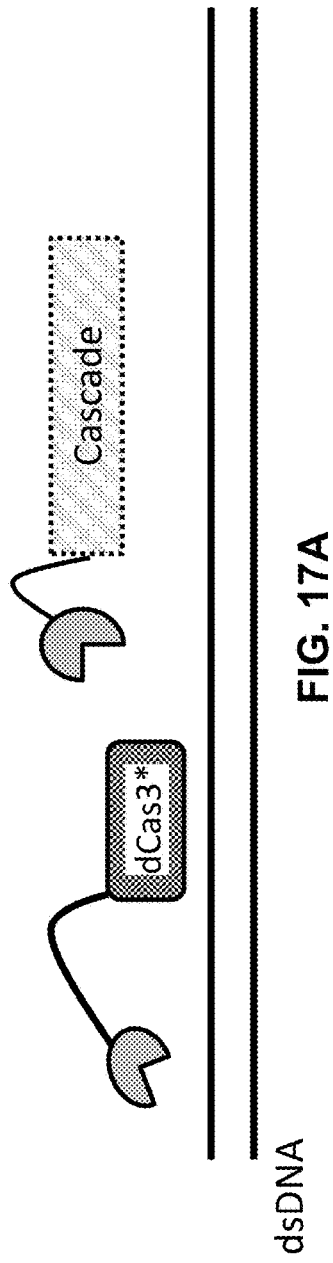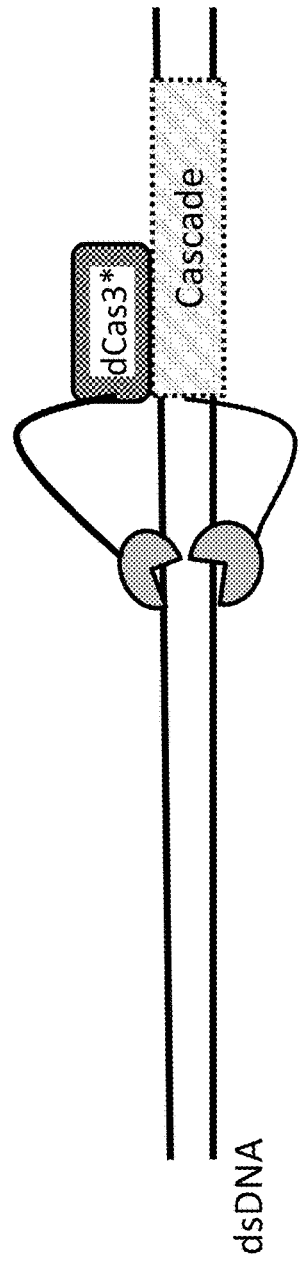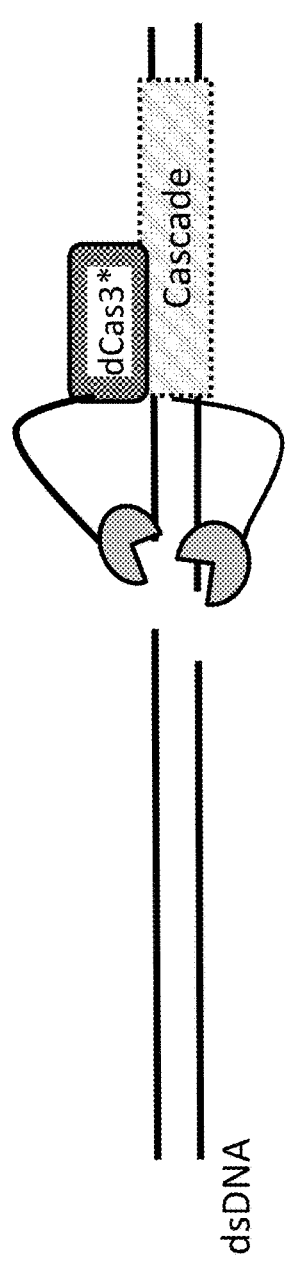
FIG. 17A
FIG. 17B
FIG. 17C

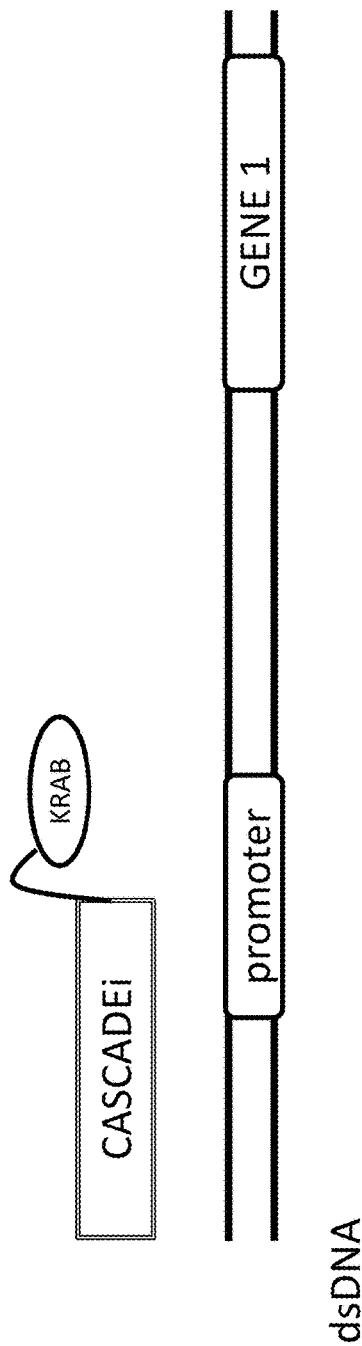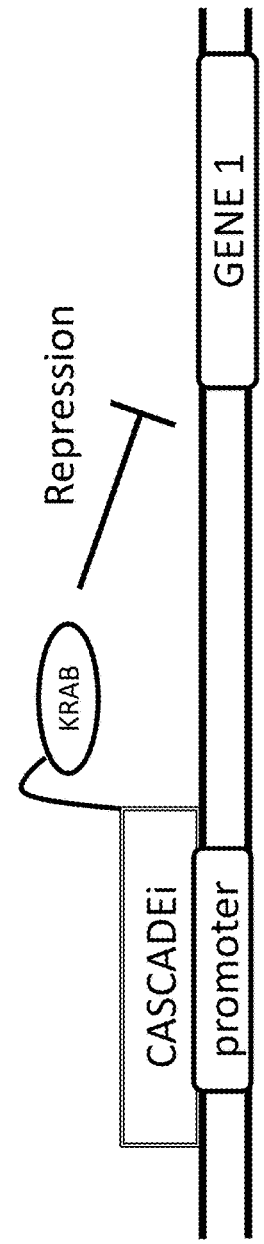
FIG. 21A
FIG. 21B

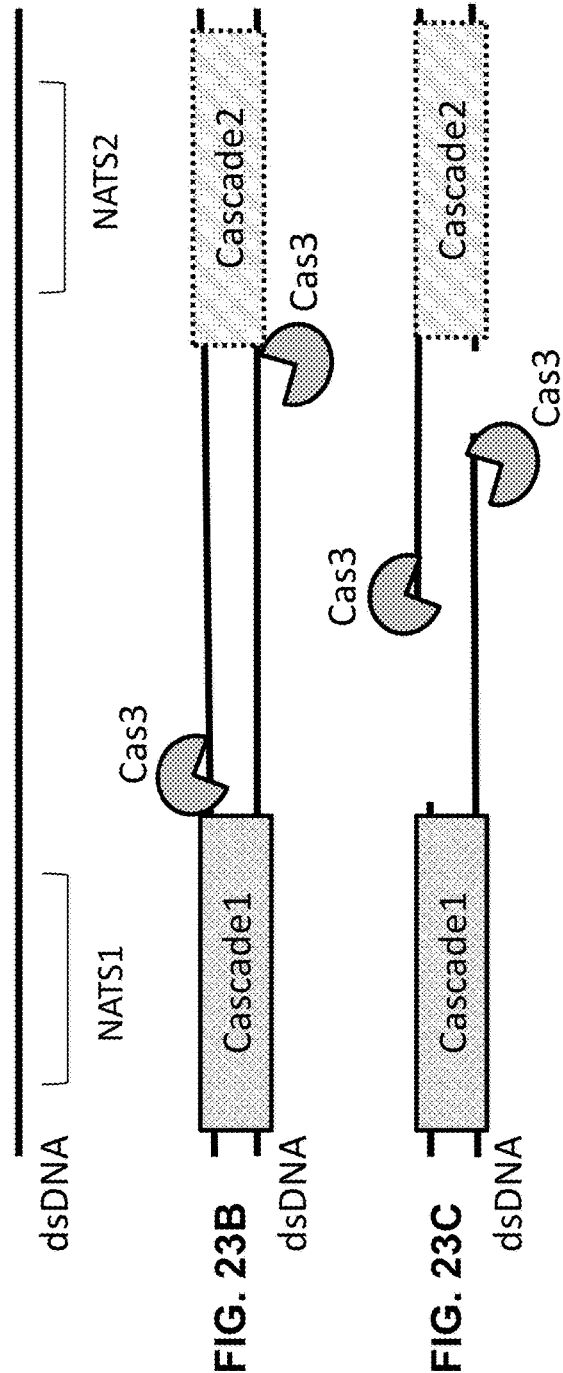
FIG. 23A
FIG. 23B
FIG. 23C
FIG. 23D

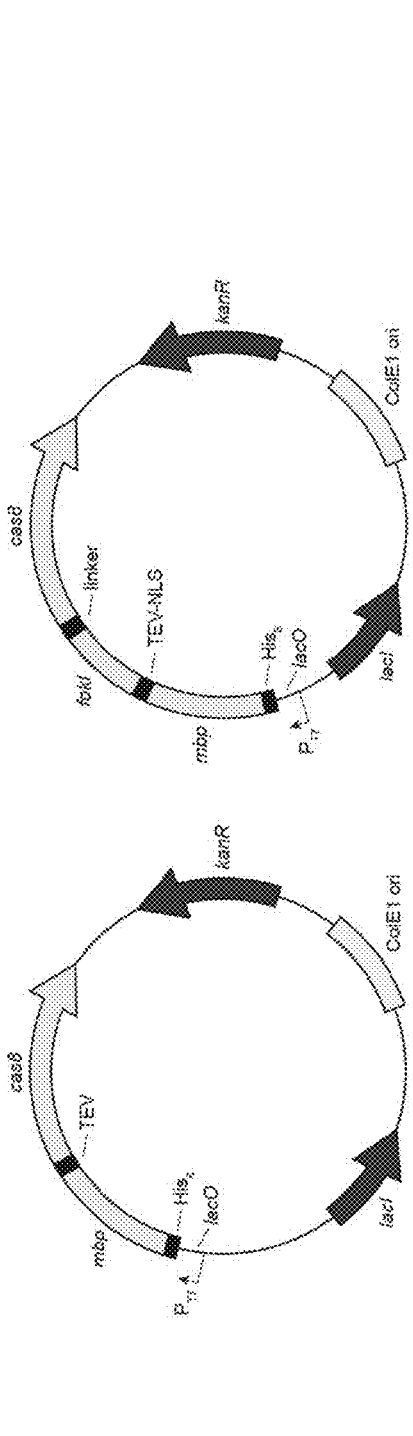
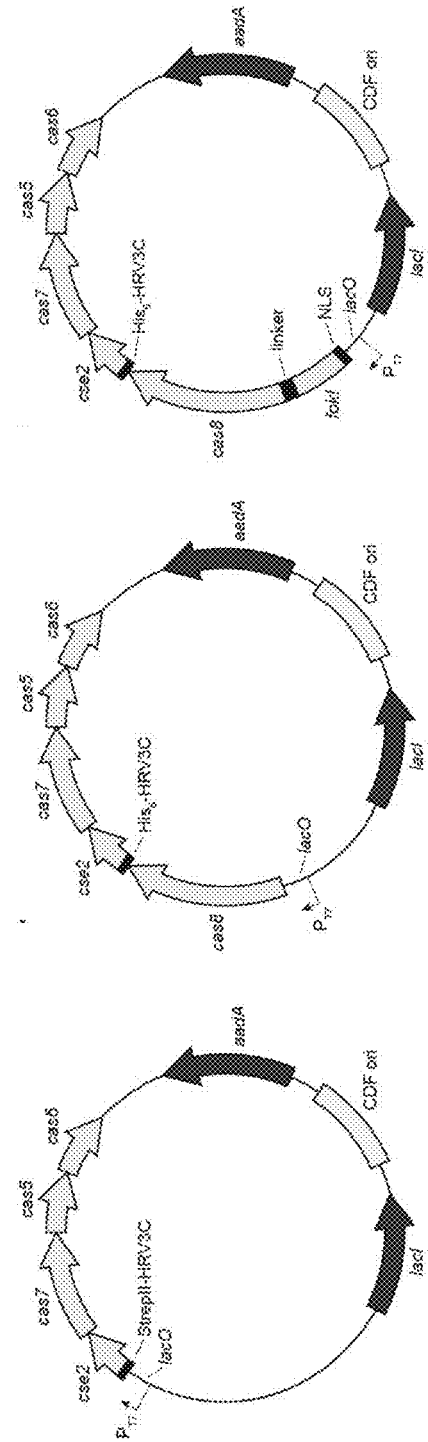
FIG. 24A
FIG. 24B
FIG. 24C
FIG. 24D
FIG. 24E

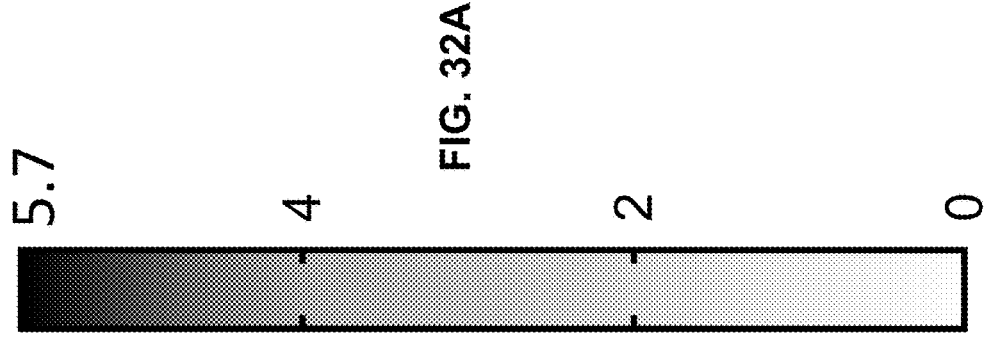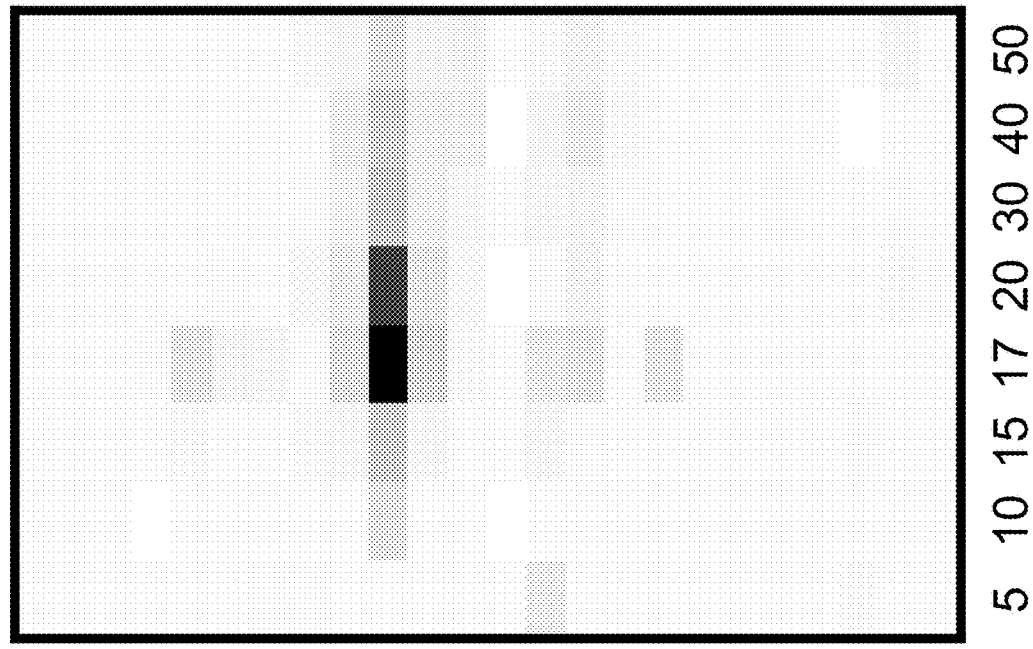
FIG. 32A

| | 5 | 10 | 15 | 17 | 20 | 30 | 40 | 50 |
|---|---|---|---|---|---|---|---|---|
| 14 | 0.07 | 0.03 | 0.03 | 0.04 | 0.06 | 0.03 | 0.04 | 0.04 |
| 16 | 0.11 | 0.02 | 0.05 | 0.09 | 0.04 | 0.04 | 0.07 | 0.04 |
| 18 | 0.04 | 0.02 | 0.04 | 0.05 | 0.02 | 0.07 | 0.01 | 0.03 |
| 20 | 0.01 | 0.00 | 0.04 | 0.14 | 0.04 | 0.11 | 0.02 | 0.06 |
| 22 | 0.04 | 0.03 | 0.17 | 1.03 | 0.09 | 0.05 | 0.06 | 0.05 |
| 24 | 0.03 | 0.03 | 0.10 | 0.36 | 0.14 | 0.10 | 0.08 | 0.06 |
| 26 | 0.12 | 0.04 | 0.09 | 0.24 | 0.06 | 0.02 | 0.08 | 0.06 |
| 28 | 0.13 | 0.01 | 0.17 | 0.14 | 0.21 | 0.12 | 0.01 | 0.16 |
| 30 | 0.10 | 0.10 | 0.24 | 1.38 | 0.83 | 0.54 | 0.71 | 0.35 |
| 32 | 0.10 | 1.14 | 2.17 | 5.67 | 5.11 | 2.39 | 2.04 | 1.26 |
| 34 | 0.06 | 0.09 | 0.24 | 1.70 | 1.02 | 0.62 | 0.60 | 0.38 |
| 36 | 0.04 | 0.04 | 0.05 | 0.16 | 0.21 | 0.25 | 0.55 | 0.48 |
| 38 | 0.02 | 0.00 | 0.02 | 0.02 | 0.00 | 0.01 | 0.00 | 0.01 |
| 40 | 0.77 | 0.08 | 0.26 | 0.80 | 0.12 | 0.24 | 0.33 | 0.18 |
| 42 | 0.04 | 0.04 | 0.12 | 1.08 | 0.43 | 0.38 | 0.73 | 0.40 |
| 44 | 0.02 | 0.01 | 0.03 | 0.08 | 0.08 | 0.12 | 0.16 | 0.19 |
| 46 | 0.01 | 0.02 | 0.01 | 0.98 | 0.02 | 0.03 | 0.01 | 0.02 |
| 48 | 0.08 | 0.06 | 0.07 | 0.08 | 0.05 | 0.05 | 0.07 | 0.08 |
| 50 | 0.04 | 0.02 | 0.05 | 0.03 | 0.05 | 0.07 | 0.05 | 0.09 |
| 52 | 0.05 | 0.10 | 0.05 | 0.10 | 0.08 | 0.12 | 0.09 | 0.13 |
| 54 | 0.04 | 0.05 | 0.01 | 0.06 | 0.03 | 0.04 | 0.05 | 0.02 |
| 56 | 0.18 | 0.03 | 0.14 | 0.09 | 0.01 | 0.02 | 0.00 | 0.05 |
| 58 | 0.09 | 0.09 | 0.05 | 0.11 | 0.16 | 0.13 | 0.11 | 0.26 |
| 60 | 0.02 | 0.02 | 0.07 | 0.07 | 0.13 | 0.01 | 0.01 | 0.11 |

FIG. 32B

ENGINEERED CASCADE COMPONENTS AND CASCADE COMPLEXES

CROSS-REFERENCE TO RELATED APPLICATIONS

This application claims the benefit of U.S. Provisional Patent Application Ser. No. 62/684,735, filed 13 Jun. 2018, the contents of which are herein incorporated by reference in its entirety.

STATEMENT REGARDING FEDERALLY SPONSORED RESEARCH OR DEVELOPMENT

Not applicable.

SEQUENCE LISTING

The present application contains a Sequence Listing that has been submitted electronically in ASCII format and is hereby incorporated by reference in its entirety. The ASCII copy, created on 17 Aug. 2018 is named CBI032-10_ST25.txt and is 2.2 MB in size.

TECHNICAL FIELD

The present disclosure relates generally to engineered Class 1 Type I CRISPR-Cas (Cascade) systems that comprise multi-protein effector complexes, nucleoprotein complexes comprising Type I CRISPR-Cas subunit proteins and nucleic acid guides, polynucleotides encoding Type I CRISPR-Cas subunit proteins, and guide polynucleotides. The disclosure also relates to compositions and methods for making and using the engineered Type I CRISPR-Cas systems of the present invention.

BACKGROUND

Clustered regularly interspaced short palindromic repeats (CRISPR) and CRISPR-associated proteins (Cas) constitute CRISPR-Cas systems. The CRISPR-Cas systems provide adaptive immunity against foreign polynucleotides in bacteria and archaea (see, e.g., Barrangou, R., et al., Science 315:1709-1712 (2007); Makarova, K. S., et al., Nature Reviews Microbiology 9:467-477 (2011); Garneau, J. E., et al., Nature 468:67-71 (2010); Sapranauskas, R., et al., Nucleic Acids Research 39:9275-9282 (2011); Koonin, E. V., et al., Curr. Opin. Microbiol. 37:67-78 (2017)). Various CRISPR-Cas systems in their native hosts are capable of DNA targeting (Class 1 Type I; Class 2 Type II and Type V), RNA targeting (Class 2 Type VI), and joint DNA and RNA targeting (Class 1 Type III) (see, e.g., Makarova, K. S., et al., Nat. Rev. Microbiol. 13(11):722-736 (2015); Shmakov, S., et al., Nat. Rev. Microbiol. 15:169-182 (2017); Abudayyeh, O. O., et al., Science 353:1-17 (2016)).

The classification of CRISPR-Cas systems has had many iterations. Koonin, E. V., et al., (Curr. Opin. Microbiol. 37:67-78 (2017)) proposed a classification system that takes into consideration the signature cas genes specific for individual types and subtypes of CRISPR-Cas systems. The classification also considered sequence similarity between multiple shared Cas proteins, the phylogeny of the best conserved Cas protein, gene organization, and the structure of the CRISPR array. This approach provided a classification scheme that divides CRISPR-Cas systems into two distinct classes: Class 1 comprising a multiprotein effector complex (Type I (CRISPR-associated complex for antiviral defense ("Cascade") effector complex), Type III (Cmr/Csm effector complex), and Type IV); and Class 2 comprising a single effector protein (Type II (Cas9), Type V (Cas12a, previously referred to as Cpf1), and Type VI (Cas13a, previously referred to as C2c2)). In the Class 1 systems, Type I is the most common and diverse, Type III is more common in archaea than bacteria, and Type IV is least common.

The Type I systems comprise the signature Cas3 protein. The Cas3 protein has helicase and DNase domains responsible for DNA target sequence cleavage. To date, seven subtypes of the Type I system have been identified (i.e., Type I-A, I-B, I-C, I-D, I-E, I-F (and variants for I-F (e.g., I-Fv1, I-Fv2), and I-U) that have a variable number of cas genes. Type I cas genes include, but are not limited to, the following: cas7, cas5, cas8, cse2, csa5, cas3, cast, cas4, cas1, and cash. Examples of organisms having Type I systems are as follows: I-A, *Archaeoglobus fulgidus*; I-B, *Clostridium kluyveri*; I-C, *Bacillus halodurans*; I-U, *Geobacter sulfurreducens*; I-D, Cyanothece sp. 8802; I-E, *Escherichia coli* K12; I-F, *Yersinia pseudo-tuberculosis*; I-F variant, *Shewanella putrefaciens* CN-32 (Koonin, E. V., et al., Curr. Opin. Microbiol. 37:67-78 (2017)).

Type I systems typically encode proteins that combine with a CRISPR RNA (crRNA or "guide RNA") to form a Cascade complex. These complexes comprise multiple proteins and a CRISPR RNA (crRNA), which are transcribed from this CRISPR locus. In Type I systems, primary processing of a pre-crRNA is catalyzed by Cas6. This typically results in a crRNA with a 5' handle of 8 nucleotides, a spacer region, and a 3' handle; both 5' and 3' handles are derived from the repeat sequence. In some systems, the 3' handle forms a stem-loop structure; in other systems, secondary processing of the 3' end of crRNA is catalyzed by ribonuclease(s) (van der Oost, J., et al., Nature Reviews Microbiology 12:479-492 (2014)).

The Cascade effector complexes of the Type I CRISPR-Cas systems comprise a backbone having paralogous Repeat-Associated Mysterious Proteins (RAMPs; e.g., Cas7 and Cas5 proteins) containing the RNA Recognition Motif (RRM) fold and additional "large" and "small" subunit proteins (see, e.g., Koonin, E. V., et al., Curr. Opin. Microbiol. 37:67-78, FIG. 2 (2017)). These Cascade effector complexes typically have a Cas5 subunit protein and several Cas7 subunit proteins. Such Cascade effector complexes also comprise the guide RNA. The Cascade effector complexes comprise the various subunit proteins arranged in an asymmetric fashion along the length of the guide RNA. The Cas5 subunit protein and the large subunit protein (Cas8 protein) are positioned at one end of the complex, enveloping the 5' end of the guide RNA. Several copies of the small subunit protein interact with the guide RNA backbone, which is bound to multiple copies of the Cas7 subunit protein. The Cas6 subunit protein, another RAMP protein, is associated with the Cascade effector complex primarily through association with the 3' handle (repeat region) of the crRNA. The Cas6 subunit protein usually functions as the repeat-specific RNase involved in pre-crRNA processing; however, in Type I-C systems, Cas5 functions as the repeat-specific RNase and there is no Cas6.

The primary sequences of the CRISPR-Cas Type I Cascade subunit proteins have little sequence identity; however, the presence of homologous RAMP modules and the overall structural similarity of the multiprotein effector complexes supports a common origin of these effector complexes (Koonin, E. V., et al., Curr. Opin. Microbiol. 37:67-78 (2017)).

The adaptive immunity mechanism of action in the Type I CRISPR-Cas systems involves essentially three phases: adaptation, expression, and interference. In the adaptation phase, a foreign DNA or RNA infects the host and proteins encoded by various cas genes bind regions of the infecting DNA or RNA. Such regions are called protospacers. A protospacer adjacent motif (PAM) is a short nucleotide sequence (e.g., 2 to 6 base pair DNA sequence) that is adjacent to the protospacer. PAM sequences are typically recognized by a Cas1 subunit protein/Cas2 subunit protein complex, wherein the active PAM-sensing site is associated with the Cas1 subunit proteins (Jackson, S. A., et al., Science 356:356(6333) (2017)).

In the expression phase, the CRISPR array comprising multiple spacer-repeat elements is transcribed as a single transcript. Individual spacer repeat elements are processed by an endonuclease (e.g., Type I, a Cas6 protein; and Type I-C, a Cas5 protein) into individual crRNAs. Cas subunit proteins are expressed and associate with the crRNA to form a Cascade effector complex.

The Cascade effector complex scans foreign polynucleotides infecting the host to identify DNA complementary to the spacer. In Type I systems, interference occurs when the effector complex identifies a sequence complementary to the spacer that is adjacent a PAM; and the Cas3 protein is recruited to the DNA-bound Cascade effector complex to cleave and progressively digest the foreign polynucleotide.

Makarova, K. S., et al., (Cell 168:946 (2017)) provide a summary of genes, homologs, Cascade complexes, and mechanisms of action for Type I CRISPR-Cas systems.

Although CRISPR-Cas systems have been used for genome editing, there remains a need to improve editing efficiency and editing fidelity of these systems.

SUMMARY OF THE INVENTION

The present invention generally relates to compositions comprising engineered Type I CRISPR-Cas effector complexes, modified guide polynucleotides, and combinations thereof.

One embodiment of the present invention is a composition comprising:

a first engineered Type I CRISPR-Cas effector complex comprising, a first Cse2 subunit protein, a first Cas5 subunit protein, a first Cas6 subunit protein, and a first Cas7 subunit protein, a first fusion protein comprising a first Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FokI, and wherein the first linker polypeptide has a length of between 10 amino acids to 40 amino acids, and a first guide polynucleotide comprising a first spacer capable of binding a first nucleic acid target sequence; and a second engineered Type I CRISPR-Cas effector complex comprising, a second Cse2 subunit protein, a second Cas5 subunit protein, a second Cas6 subunit protein, and a second Cas7 subunit protein, a second fusion protein comprising a second Cas8 subunit protein and a second FokI, wherein the N-terminus of the second Cas8 subunit protein or the C-terminus of the second Cas8 protein is covalently connected by a second linker polypeptide to the C-terminus or N-terminus, respectively, of the second FokI, and wherein the second linker polypeptide has a length of between 10 amino acids to 40 amino acids, and a second guide polynucleotide comprising a second spacer capable of binding a second nucleic acid target sequence, wherein a protospacer adjacent motif (PAM) of the second nucleic acid target sequence and a PAM of the first nucleic acid target sequence have an interspacer distance between 20 base pairs (bp) to 42 bp.

In some embodiments, the length of the first linker polypeptide and/or the second linker polypeptide is a length of between about 15 amino acids and about 30 amino acids, or between about 17 amino acids and about 20 amino acids. In one embodiment, the length of the first linker polypeptide and the second linker polypeptide are the same.

Interspacer distances between the second nucleic acid target sequence and the first nucleic acid target sequence include, but are not limited to, between about 22 bp to about 40 bp, between about 26 bp to about 36 bp, between about 29 bp to about 35 bp, or between about 30 bp to about 34 bp.

The first FokI and the second FokI can be monomeric subunits that are capable of associating to form a homodimer, or distinct subunits that are capable of associating to form a heterodimer.

In some embodiments, the N-terminus of the first Cas8 subunit protein is covalently connected by the first linker polypeptide to the C-terminus of the first FokI, the C-terminus of the first Cas8 subunit protein is covalently connected by a first linker polypeptide to the N-terminus of the first FokI, the N-terminus of the second Cas8 subunit protein is covalently connected by the second linker polypeptide to the C-terminus of the second FokI, the C-terminus of the second Cas8 subunit protein is covalently connected by a second linker polypeptide to the N-terminus of the second FokI, and combinations thereof. The first Cas8 subunit protein and the second Cas8 subunit protein can each comprise a Cas8 subunit protein having a different sequence or both the first and the second Cas8 subunit protein can comprise identical amino acid sequences.

Similarly, the first Cse2 subunit protein and the second Cse2 subunit protein can each comprise different or identical Cse2 subunit protein amino acid sequences, the first Cas5 subunit protein and the second Cas5 subunit protein can each comprise different or identical Cas5 subunit protein amino acid sequences, the first Cas6 subunit protein and the second Cas6 subunit protein can each comprise different or identical Cas6 subunit protein amino acid sequences, the first Cas7 subunit protein and the second Cas7 subunit protein can each comprise different or identical Cas7 subunit protein amino acid sequences, and combinations thereof.

In a preferred embodiment, the guide polynucleotides comprise RNA.

Additional embodiments of the present invention will be readily apparent to those of ordinary skill in the art in view of the disclosures herein.

BRIEF DESCRIPTION OF THE FIGURES

The Figures are not proportionally rendered, nor are they to scale. The locations of indicators are approximate.

FIG. 2A, FIG. 2B, and FIG. 2C present illustrative examples of two engineered Type I CRISPR-Cas effector complexes with fusion domains bound to neighboring spacer sequences.

FIG. 3 presents information related to SEQ ID NO:1 to SEQ ID NO:351.

FIG. 4A and FIG. 4B present examples of circularly permuted proteins.

FIG. 5A, FIG. 5B, FIG. 6A, FIG. 6B, FIG. 7A, FIG. 7B, FIG. 7C, FIG. 8A, FIG. 8B, FIG. 9, FIG. 10, FIG. 11A, and FIG. 11B illustrate a variety of examples of engineered Type I CRISPR-Cas effector complexes of the present invention.

FIG. 13A, FIG. 13B, and FIG. 13C present a generalized illustration of site-directed recruitment of a functional protein domain fused to a Cascade subunit protein by a dCas9:NATNA complex.

FIG. 14A, FIG. 14B, FIG. 15A, FIG. 15B, and FIG. 15C illustrate examples of engineered Type I CRISPR-Cas effector complexes of the present invention.

FIG. 16A, FIG. 16B, FIG. 16C, FIG. 17A, FIG. 17B, FIG. 17C, FIG. 18A, FIG. 18B, FIG. 18C, FIG. 19A, FIG. 19B, FIG. 19C, FIG. 19D, FIG. 20A, FIG. 20B, FIG. 21A, and FIG. 21B present examples of engineered Type I CRISPR-Cas effector complexes of the present invention and methods of use thereof.

FIG. 22A, FIG. 22B, FIG. 22C, FIG. 22D, FIG. 23A, FIG. 23B, FIG. 23C, and FIG. 23D illustrate embodiments of the present invention that use a Cas3 protein comprising active endonuclease activity.

FIG. 24A, FIG. 24B, FIG. 24C, FIG. 24D, FIG. 24E, FIG. 25, FIG. 26, FIG. 27, and FIG. 28 present schematic diagrams of a variety of Cascade component expression systems.

FIG. 29, FIG. 30, FIG. 31, FIG. 32A, FIG. 32B, FIG. 33, FIG. 34A, FIG. 34B, and FIG. 35 present data related to genome editing of the engineered Cascade systems of the present invention.

INCORPORATION BY REFERENCE

Figure 1A:
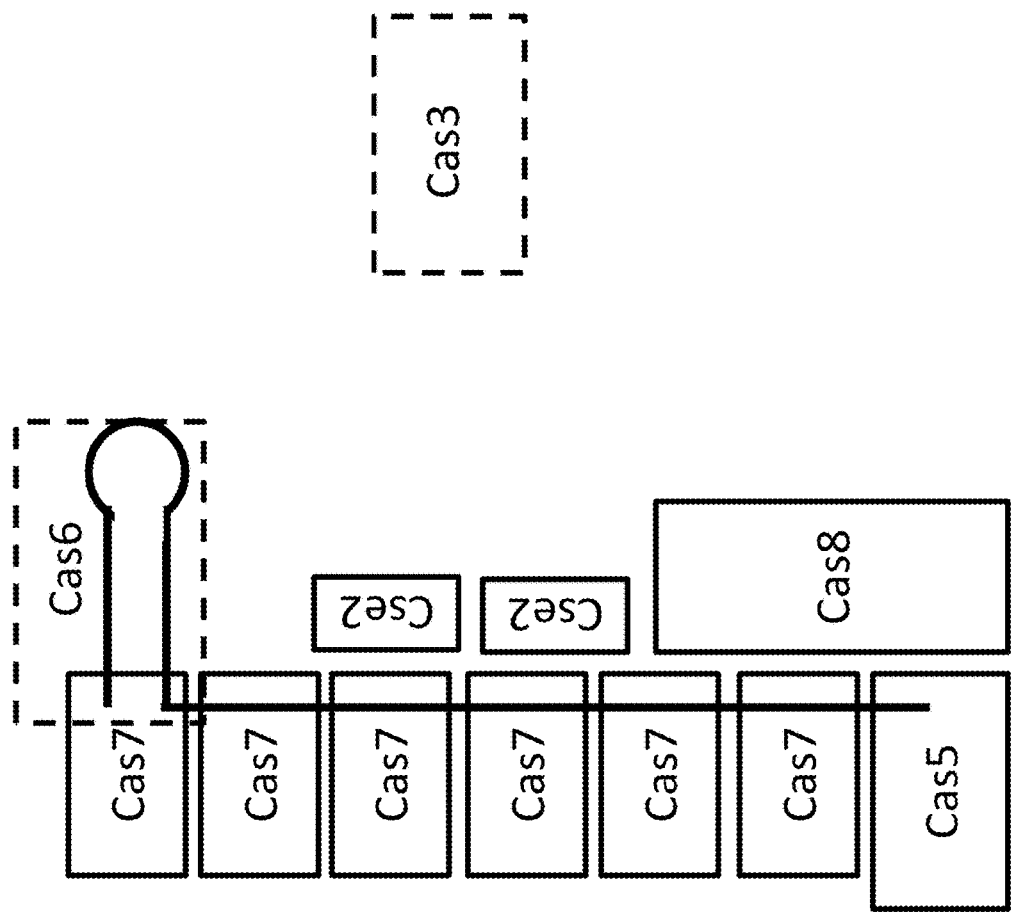
FIG. 1A present a generalized illustration of a Type I CRISPR-Cas effector complex.

All patents, publications, and patent applications cited in the present Specification are herein incorporated by reference as if each individual patent, publication, or patent application was specifically and individually indicated to be incorporated by reference in its entirety for all purposes.

DETAILED DESCRIPTION OF THE INVENTION

It is to be understood that the terminology used herein is for the purpose of describing particular embodiments only, and is not intended to be limiting. As used in the present Specification and the Claims, the singular forms "a," "an," and "the" include plural referents unless the context clearly dictates otherwise. Thus, for example, reference to "a polynucleotide" includes one or more polynucleotides, and reference to "a vector" includes one or more vectors.

Unless defined otherwise, all technical and scientific terms used herein have the same meaning as commonly understood by one of ordinary skill in the art to which the invention pertains. Although other methods and materials similar, or equivalent, to those described herein can be useful in the present invention, preferred materials and methods are described herein.

In view of the teachings of the present Specification and the Examples, one of ordinary skill in the art can apply conventional techniques of immunology, biochemistry, chemistry, molecular biology, microbiology, cell biology, genomics, and recombinant polynucleotides, as taught, for example, by the following standard texts: Cellular and Molecular Immunology, Ninth Edition, A. K. Abbas., et al., Elsevier (2017), ISBN 978-0323479783; Cancer Immunotherapy Principles and Practice, First Edition, L. H. Butterfield, et al., Demos Medical (2017), ISBN 978-1620700976; Janeway's Immunobiology, Ninth Edition, Kenneth Murphy, Garland Science (2016), ISBN 978-0815345053; Clinical Immunology and Serology: A Laboratory Perspective, Fourth Edition, C. Dorresteyn Stevens, et al., F. A. Davis Company (2016), ISBN 978-0803644663; Antibodies: A Laboratory Manual, Second edition, E. A. Greenfield, Cold Spring Harbor Laboratory Press (2014), ISBN 978-1-936113-81-1; Culture of Animal Cells: A Manual of Basic Technique and Specialized Applications, Seventh Edition, R. I. Freshney, Wiley-Blackwell (2016), ISBN 978-1118873656; Transgenic Animal Technology, Third Edition: A Laboratory Handbook, C. A. Pinkert, Elsevier (2014), ISBN 978-0124104907; The Laboratory Mouse, Second Edition, H. Hedrich, Academic Press (2012), ISBN 978-0123820082; Manipulating the Mouse Embryo: A Laboratory Manual, Fourth Edition, R. Behringer, et al., Cold Spring Harbor Laboratory Press (2013), ISBN 978-1936113019; PCR 2: A Practical Approach, M. J. McPherson, et al., IRL Press (1995), ISBN 978-0199634248; Methods in Molecular Biology (Series), J. M. Walker, ISSN 1064-3745, Humana Press; RNA: A Laboratory Manual, D. C. Rio, et al., Cold Spring Harbor Laboratory Press (2010), ISBN 978-0879698911; Methods in Enzymology (Series), Academic Press; Molecular Cloning: A Laboratory Manual (Fourth Edition), M. R. Green, et al., Cold Spring Harbor Laboratory Press (2012), ISBN 978-1605500560; Bioconjugate Techniques, Third Edition, G. T. Hermanson, Academic Press (2013), ISBN 978-0123822390; Methods in Plant Biochemistry and Molecular Biology, W. V. Dashek, CRC Press (1997), ISBN 978-0849394805; Plant Cell Culture Protocols (Methods in Molecular Biology), V. M. Loyola-Vargas, et al., Humana Press (2012), ISBN 978-1617798177; Plant Transformation Technologies, C. N. Stewart, et al., Wiley-Blackwell (2011), ISBN 978-0813821955; Recombinant Proteins from Plants (Methods in Biotechnology), C. Cunningham, et al., Humana Press (2010), ISBN 978-1617370212; Plant Genomics: Methods and Protocols (Methods in Molecular Biology), W. Busch, Humana Press (2017), ISBN 978-1493970018; Plant Biotechnology: Methods in Tissue Culture and Gene Transfer, R. Keshavachandran, et al., Orient Blackswan (2008), ISBN 978-8173716164.

Clustered regularly interspaced short palindromic repeats (CRISPR) and related CRISPR-associated proteins (Cas proteins) constitute CRISPR-Cas systems (see, e.g., Barrangou, R., et al., Science 315:1709-1712 (2007)).

As used herein, "Cas protein," "CRISPR-Cas protein," and "CRISPR-Cas subunit protein," and "Cas subunit protein," unless otherwise identified, all refer to Class 1 Type I CRISPR-Cas proteins. Typically, for use in aspects of the present invention, Cas subunit proteins are capable of interacting with one or more cognate polynucleotides (most typically, a crRNA) to form a Type I effector complex (most typically, a ribonucleoprotein complex). Genes encoding Cas subunit proteins are listed in Table 1.

TABLE 1

Type I CRISPR-Cas Proteins

| Role | Universal family name* | Alternative designation | Reported stoichiometry (when present) |
|---|---|---|---|
| RNA 5' cap, PAM recognition, duplex unwinding | Cas5 | CasD, Cas5e, Csc1, Csy2, Csf3, Cas1822 | 1 |
| PAM recognition, duplex unwinding, Cas3 recruitment | Cas8 | Large subunit, CasA, Cse1, Cas8a, Cas8b, Cas8c, Cas8e, Cas8f, Csy1 | 1 |
| R-loop stabilization | Cse2 | Small subunit, CasB, Cas11 | 2 |
| Backbone | Cas7 | CasC, Cse4, Csc2, Csy3, Csf2, Cas1821, Cst2/DevR | 3-6 |
| RNA 3' cap | Cas6 | CasE, Cse3, Cas6e, Cas6f, Csy4 | 1 |
| DNA cleavage | Cas3 | Cas3', Cas3" | 1 |

*As defined by Makarova K.S., et al., Nat. Rev. Microbiol. 13(11):722-736 (2015); Koonin, E.V., et al., Curr Opin Microbiol. 37:67-78 (2017).

The terms "Type I CRISPR-Cas effector complex," "Cascade complex," "Type I CRISPR-Cas nucleoprotein complex," and "Type I complexes" are used interchangeably herein. The terms "Cascade RNP complex" and "Type I ribonucleoprotein (RNP) complex" refer to a Cascade complex specifically comprising a crRNA (versus a more generic guide polynucleotide, as described below). An example of a wild-type Type I CRISPR-Cas effector complex is illustrated in FIG. 1A. FIG. 1A is adapted from Makarova, K. S., et al., (Cell 168:946 (2017); and Makarova, K., et al., Nature reviews Microbiology 13(11):722-736 (2015)). doi:10.1038/nrmicro3569.). FIG. 1A illustrates six Cas7 proteins, a Cas5 protein, a Cas8 protein, two Cse2 proteins, a Cas6 protein, and a crRNA associated as a Cascade complex. The complex is capable of binding a nucleic acid target sequence. After association of a wild-type Cas3 with the complex, the Cascade complex is capable of cleavage of a nucleic acid target sequence. As noted in Table 1, the total number of some Cas subunit proteins can vary in Cascade complexes.

"Cas3" and "Cas3 protein" are used interchangeably herein to refer to Type I CRISPR-Cas3 proteins, modifications, and variants thereof. The Type I CRISPR-Cas effector complexes bind foreign DNA complementary to the crRNA guide and recruit Cas3, a trans-acting nuclease-helicase required for target degradation. Cas3 proteins have motifs characteristic of helicases from superfamily 2 and contain a DEAD/DEAH box region and a conserved C-terminal domain. Cas3 proteins and variants thereof are known in the art (see, e.g., Westra, E. R., et al., Mol Cell. 46(5): 595-605 (2012); Sinkunas, T., et al., EMBO J. 30(7):1335-1342 (2011); Beloglazova, N., et al., EMBO J. 30:4616-4627 (2011); Mulepati, S., et al., J. Biol. Chem. 286:31896-31903 (2011)). As used herein, dCas3* is a mutated Cas3 protein that does not have any nuclease activity and/or helicase activity.

The term "nuclease" as used herein refers to an enzyme capable of cleaving the phosphodiester bonds, such as those connecting two nucleotides, as found in double-stranded (ds) nucleic acids (e.g., dsDNA, genomic DNA (gDNA), dsRNA), single-stranded (ss) nucleic acids (e.g., ssDNA, RNA) or hybrid dsRNA/DNA. An "endonuclease" typically can effect ss- (nicks) or ds-breaks in its target molecules. One example of a DNA endonuclease is a FokI enzyme. "FokI endonuclease" and "FokI" are used interchangeably herein and refer to a FokI enzyme, FokI homologs, enzymatically active domain(s) of FokI enzymes, and variants of FokI enzymes. FokI dimerization is typically required for DNA cleavage. Dimers of FokI can comprise two monomeric subunits that associate to form a homodimer or two distinct monomeric subunits that associate to form a heterodimer (see, e.g., Bitinaite, J., et al., Proceedings of the National Academy of Sciences 95(18):10570-10575 (1998); Ramalingam, S., et al., Journal of Molecular Biology, 405 (3):630-641 (2011)). One example of a FokI variant is the Sharkey variant described by Guo, et al. (Guo, J., et al., J. Mol. Biol. 400:96-107 (2010)). Additional DNA and RNA nucleases are known in the art.

Figure 1B:
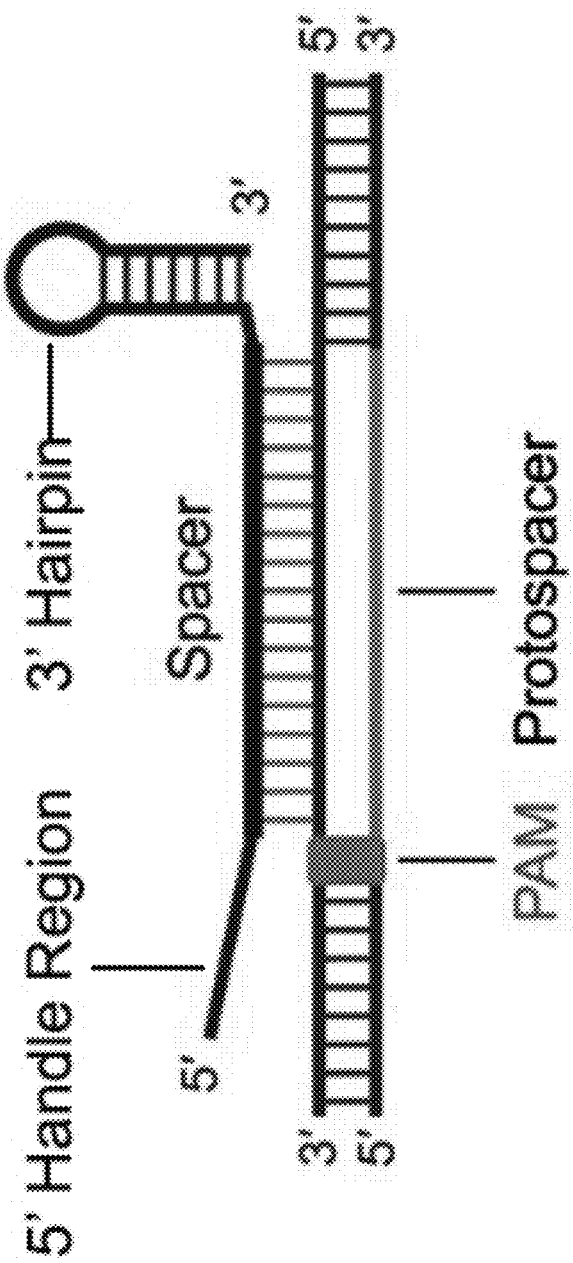
FIG. 1B presents a generalized illustration of a Type I CRISPR-Cas crRNA.

"CRISPR RNA," "crRNA," and "guide RNA," as used herein, refer to one or more RNAs with which Cas subunit proteins are capable of interacting to form a Type I effector complex that guides the complex to preferentially bind a nucleic acid target sequence in a polynucleotide (relative to a polynucleotide that does not comprise the nucleic acid target sequence). "Guide" and "guide polynucleotide" as used herein refer to the polynucleotide component of Type I effector complexes and can comprise ribonucleotide bases (e.g., RNA), deoxyribonucleotide bases (e.g., DNA), combinations of ribonucleotide bases and deoxyribonucleotide bases, nucleotides, nucleotide analogs, modified nucleotides, and the like, as well as synthetic, naturally occurring, and non-naturally occurring modified backbone residues or linkages, for example, as described herein. An example of a Type I CRISPR-Cas crRNA associated with a nucleic acid target sequence through the crRNA spacer is illustrated in FIG. 1B. FIG. 1B is adapted from Hochstrasser, M. L., et al., Molecular Cell 63(5):840-851 (2016). In FIG. 1B, the PAM associated with the nucleic acid target sequence and the 5' and 3' strands of a double-stranded nucleic acid are illustrated (FIG. 1B, vertical lines represent hydrogen bonds). A guide polynucleotide typically comprises a 5' handle region (FIG. 1B, 5' Handle Region), a spacer region (FIG. 1B, Spacer) comprising a seed region, and a 3' hairpin comprising two hydrogen-bonded repeat regions (FIG. 1B, 3' Hairpin; horizontal lines represent hydrogen bonds). FIG. 1B illustrates the Cascade complex spacer bound to the nucleic acid target sequences (FIG. 1B, vertical lines represent hydrogen bonds). FIG. 1B also illustrates the protospacer region (FIG. 1B, protospacer). The spacer can comprise a region of the crRNA between about 6 to about 56 nucleotides, wherein the spacer is complementary to a nucleic acid target sequence in a polynucleotide. The spacer length can be modified to fine-tune Cascade activity in Type I-E CRISPR-Cas systems. Cascade complexes can incorporate an extra Cas7 subunit with every 6 nucleotides added to the crRNA spacer and an extra Cse2 subunit with every 12 nucleotides added to the spacer (Luo, M. L., et al., Nucleic Acids Research. 44(15):7385-7394 (2016)). The spacer typically comprises a region of between about 32 to about 36 nucleotides.

The terms "spacer," "spacer sequence," and "nucleic acid target binding sequence" are used interchangeably herein.

As used herein, a "stem element" or "stem structure" refers to two strands of nucleic acid's that are known or predicted to form a double-stranded region (the "stem element"). A "stem-loop element" or "stem-loop structure" refers to a stem structure wherein 3'-end sequences of one strand are covalently bonded to 5'-end sequences of the second strand by a nucleotide sequence of typically single-stranded nucleotides ("a stem-loop element nucleotide sequence"). In some embodiments, the loop element comprises a loop element nucleotide sequence of between about 3 and about 20 nucleotides in length, preferably between about 4 and about 10 nucleotides in length. In preferred embodiments, a loop element nucleotide sequence is a single-stranded nucleotide sequence of unpaired nucleic acid bases that do not interact through hydrogen bond formation to create a stem element within the loop element nucleotide sequence. The term "hairpin element" is also used herein to refer to stem-loop structures. Such structures are well known in the art. The base pairing may be exact; however, as is known in the art, a stem element does not require exact base pairing. Thus, the stem element may include one or more base mismatches or non-paired bases. An example of a stem-loop structure in a guide polynucleotide is illustrated in FIG. 1B.

A "linker element nucleotide sequence," "linker nucleotide sequence," and "linker polynucleotide" are used interchangeably herein and refer to either a single-stranded nucleic acid sequence or a double-stranded nucleic acid sequence of one or more nucleotides covalently attached to a first nucleic acid sequence (e.g., 5'-linker nucleotide sequence-first nucleic acid sequence-3'). In some embodiments, a linker nucleotide sequence connects two separate nucleic acid sequences to form a single polynucleotide (e.g., 5'-first nucleic acid sequence-linker nucleotide sequence-second nucleic acid sequence-3'). Other examples of linker nucleotide sequences include, but are not limited to, 5'-first nucleic acid sequence-linker nucleotide sequence-3' and 5'-linker nucleotide sequence-first first nucleic acid sequence-linker nucleotide sequence-3'. In some embodiments, the linker element nucleotide sequence can be a single-stranded nucleotide sequence of unpaired nucleic acid bases that do not interact with each other through hydrogen bond formation to create a secondary structure (e.g., a stem-loop structure) within the linker element nucleotide sequence. In some embodiments, two linker element nucleotide sequences can interact with each other through hydrogen bonding between the two linker element nucleotide sequences. In some embodiments, a linker polynucleotide encodes a "linker polypeptide." Such a linker polynucleotide typically connects the 3' end of a first polynucleotide encoding a first polypeptide to, the 5' end of a second polynucleotide encoding a second polypeptide to form a single polynucleotide that encodes a fusion protein comprising N-the first polypeptide-the linker polypeptide-the second polypeptide-C. In some embodiments of the present invention, more than two polypeptide sequences can be connected in tandem by linker polypeptides (e.g., N-a first polypeptide-a first linker polypeptide-a second polypeptide-a second linker polypeptide-a third polypeptide-C). Linker polypeptide, "linker polypeptide sequence," "amino acid linker sequence," and "linker sequence" are used interchangeably herein.

As used herein, a "connecting nucleotide sequence" refers to a single-stranded nucleic acid sequence linker sequence that covalently connects a first nucleic acid sequence and a second nucleic acid sequence.

Figure 2C:
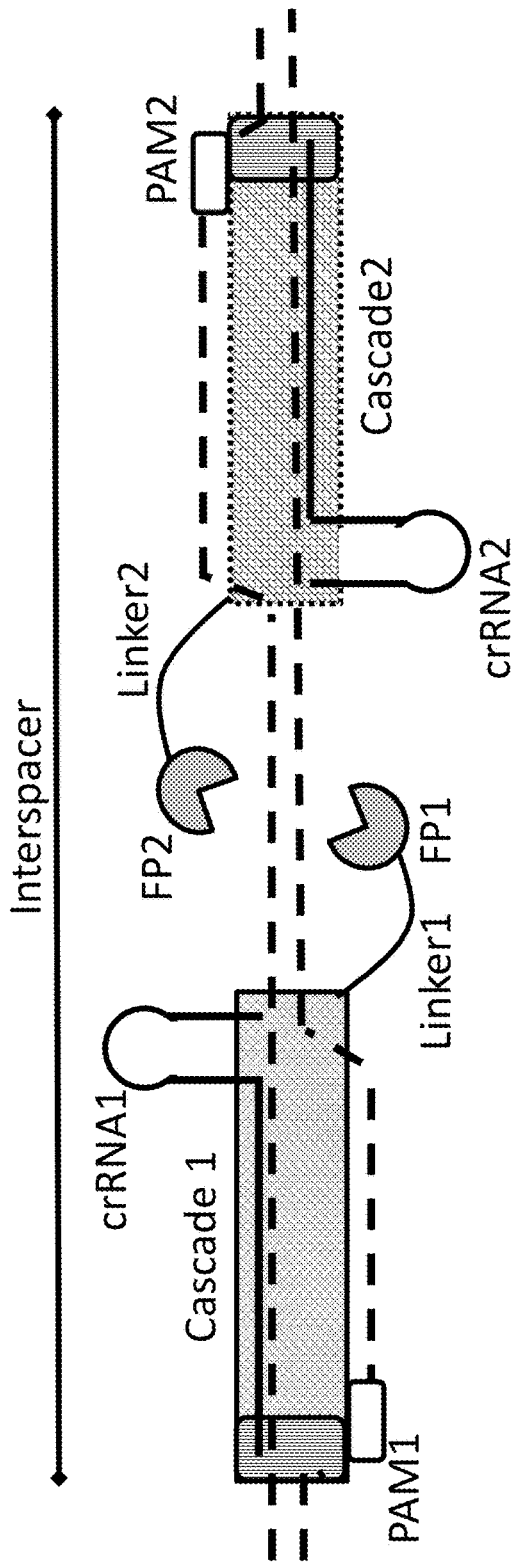

As used herein, the terms "interspacer," "interspacer region," and "interspacer distance" are used interchangeably and refer to the distance between a PAM of a first nucleic acid target sequence (e.g., a first DNA target sequence) and a PAM of a second nucleic acid target sequence (e.g., a second DNA target sequence) typically in a PAM-in orientation, wherein a first Type I CRISPR-Cas effector complex comprises a first spacer capable of binding the first nucleic acid target sequence, and a second Type I CRISPR-Cas effector complex comprises a second spacer capable of binding the second nucleic acid target sequence. FIG. 2A, FIG. 2B, and FIG. 2C present illustrative examples of two Type I CRISPR-Cas effector complexes ("Cascade1" comprising "crRNA1" and "Cascade2" comprising "crRNA2") comprising fusion proteins ("FP1" and "FP2"; e.g., FokI) connected with each Cascade complex through linker polynucleotides ("Linker1" and "Linker2"), wherein the CRISPR-Cas effector complexes are bound to neighboring nucleic acid target sequences on double-stranded DNA ("dsDNA"). PAM sequences associated with each nucleic acid target sequence are indicated ("PAM1," open box, and "PAM2," open box)). FIG. 2A illustrates an interspacer (shown as a double-arrowheaded line) between two target sites in a PAM-in (PAM-in/PAM-in) configuration. FIG. 2B illustrates an interspacer (shown as a double-arrowheaded line) between two target sites in a PAM-in/PAM-out configuration. FIG. 2C illustrates an interspacer between two target sites in the PAM-out (PAM-out/PAM-out) configuration. FIG. 2A, FIG. 2B, and FIG. 2C also illustrate the separation of the two strands of the dsDNA. A Cascade complex recognizes a dsDNA target sequence adjacent a PAM. PAM sequences are recognized by Cse1. Base pairing between the crRNA and complementary target DNA strand results in an R-loop with the displaced non-complementary target DNA strand (Beloglazova, N., et al., Nucleic Acids Research 43(1):530-543 (2015)).

As used herein, the term "cognate" typically refers to a group of Cas subunit proteins (e.g., Cse2, Cas5, Cas6, Cas7, and Cas8) and one or more guide polynucleotides (e.g., a Type I CRISPR-Cas RNA) that are capable of forming a nucleoprotein complex capable of site-directed binding to a nucleic acid target sequence complementary to a spacer present in one of the one or more guide polynucleotides.

The terms "wild-type," "naturally occurring," and "unmodified" are used herein to mean the typical (or most common) form, appearance, phenotype, or strain existing in nature; for example, the typical form of cells, organisms, polynucleotides, proteins, macromolecular complexes, genes, RNAs, DNAs, or genomes as they occur in, and can be isolated from, a source in nature. The wild-type form, appearance, phenotype, or strain serve as the original parent before an intentional modification. Thus, mutant, variant, engineered, recombinant, and modified forms are not wild-type forms.

As used herein, the terms "engineered," "genetically engineered," "recombinant," "modified," "non-naturally occurring," "non-natural," and "non-native" are interchangeable and indicate intentional human manipulation.

"Covalent bond," "covalently attached," "covalently bound," "covalently linked," "covalently connected," and "molecular bond" are used interchangeably herein and refer to a chemical bond that involves the sharing of electron pairs between atoms. Examples of covalent bonds include, but are not limited to, phosphodiester bonds, phosphorothioate bonds, disulfide bonds and peptide bonds (—CO—NH—).

"Non-covalent bond," "non-covalently attached," "non-covalently bound," "non-covalently linked," "non-covalent interaction," and "non-covalently connected" are used interchangeably herein and refer to any relatively weak chemical bond that does not involve sharing of a pair of electrons. Multiple non-covalent bonds often stabilize the conformation of macromolecules and mediate specific interactions between molecules. Examples of non-covalent bonds include, but are not limited to, hydrogen bonding, ionic interactions (e.g., $Na^+Cl^-$), van der Waals interactions, and hydrophobic bonds.

As used herein, "hydrogen bonding," "hydrogen-base pairing," and "hydrogen bonded" are used interchangeably and refer to canonical hydrogen bonding and non-canonical hydrogen bonding including, but not limited to, "Watson- Crick-hydrogen-bonded base pairs" (W—C-hydrogen-bonded base pairs or W—C hydrogen bonding); "Hoogsteen-hydrogen-bonded base pairs" (Hoogsteen hydrogen bonding); and "wobble-hydrogen-bonded base pairs" (wobble hydrogen bonding). W—C hydrogen bonding, including reverse W—C hydrogen bonding, refers to purine-pyrimidine base pairing, e.g., adenine:thymine, guanine:cytosine, and uracil:adenine. Hoogsteen hydrogen bonding, including reverse Hoogsteen hydrogen bonding, refers to a variation of base pairing in nucleic acids wherein two nucleobases, one on each strand, are held together by hydrogen bonds in the major groove. This non-W—C hydrogen bonding can allow a third strand to wind around a duplex and form triple-stranded helices. Wobble hydrogen bonding, including reverse wobble hydrogen bonding, refers to a pairing between two nucleotides in RNA molecules that does not follow Watson-Crick base pair rules. There are four major wobble base pairs: guanine:uracil, inosine (hypoxanthine):uracil, inosine-adenine, and inosine-cytosine. Rules for canonical hydrogen bonding and non-canonical hydrogen bonding are known to those of ordinary skill in the art (see, e.g., The RNA World, Third Edition (Cold Spring Harbor Monograph Series), R. F. Gesteland, Cold Spring Harbor Laboratory Press (2005), ISBN 978-0879697396; The RNA World, Second Edition (Cold Spring Harbor Monograph Series), R. F. Gesteland, et al., Cold Spring Harbor Laboratory Press (1999), ISBN 978-0879695613; The RNA World (Cold Spring Harbor Monograph Series), R. F. Gesteland, et al., Cold Spring Harbor Laboratory Press (1993), ISBN 978-0879694562 (see, e.g., Appendix 1: Structures of Base Pairs Involving at Least Two Hydrogen Bonds, I. Tinoco); Principles of Nucleic Acid Structure, W. Saenger, Springer International Publishing AG (1988), ISBN 978-0-387-90761-1; Principles of Nucleic Acid Structure, First Edition, S. Neidle, Academic Press (2007), ISBN 978-01236950791).

"Connect," "connected," and "connecting" are used interchangeably herein and refer to a covalent bond or a non-covalent bond between two macromolecules (e.g., polynucleotides, proteins, and the like).

As used herein, the terms "nucleic acid sequence," "nucleotide sequence," and "oligonucleotide" are interchangeable and refer to a polymeric form of nucleotides. As used herein, the term "polynucleotide" refers to a polymeric form of nucleotides that has one 5' end and one 3' end, and can comprise one or more nucleic acid sequences. A "circular polynucleotide" refers to a polynucleotide having a covalent bond between its 5' end and 3' end, thus forming the circular polynucleotide. The nucleotides may be deoxyribonucleotides (DNA), ribonucleotides (RNA), analogs thereof, or combinations thereof, and may be of any length. Polynucleotides may perform any function and may have various secondary and tertiary structures. The terms encompass known analogs of natural nucleotides and nucleotides that are modified in the base, sugar, and/or phosphate moieties. Analogs of a particular nucleotide have the same base-pairing specificity (e.g., an analog of A base pairs with T). A polynucleotide may comprise one modified nucleotide or multiple modified nucleotides. Examples of modified nucleotides include, but are not limited to, fluorinated nucleotides, methylated nucleotides, and nucleotide analogs. Nucleotide structure may be modified before or after a polymer is assembled. Following polymerization, polynucleotides may be additionally modified via, for example, conjugation with a labeling component or target binding component. A nucleotide sequence may incorporate non-nucleotide components. Also encompassed are nucleic acids comprising modified backbone residues or linkages, that are synthetic, naturally occurring, and/or non-naturally occurring, and have similar binding properties as a reference polynucleotide (e.g., DNA or RNA). Examples of such analogs include, but are not limited to, phosphorothioates, phosphoramidates, methyl phosphonates, chiral-methyl phosphonates, 2-O-methyl ribonucleotides, peptide-nucleic acids (PNAs), Locked Nucleic Acid (LNA™) (Exiqon, Inc., Woburn, Mass.) nucleosides, glycol nucleic acid, bridged nucleic acids, and morpholino structures.

Peptide-nucleic acids (PNAs) are synthetic homologs of nucleic acids wherein the polynucleotide phosphate-sugar backbone is replaced by a flexible pseudo-peptide polymer, and nucleobases are linked to the polymer. PNAs have the capacity to hybridize with high affinity and specificity to complementary sequences of RNA and DNA.

In phosphorothioate nucleic acids, the phosphorothioate (PS) bond substitutes a sulfur atom for a non-bridging oxygen in the polynucleotide phosphate backbone. This modification makes the internucleotide linkage resistant to nuclease degradation. In some embodiments, phosphorothioate bonds are introduced between the last 3 to 5 nucleotides at the 5'-end or 3'-end sequences of a polynucleotide sequence to inhibit exonuclease degradation. Placement of phosphorothioate bonds throughout an entire oligonucleotide helps reduce degradation by endonucleases, as well.

Threose nucleic acid (TNA) is an artificial genetic polymer. The backbone structure of TNA comprises repeating threose sugars linked by phosphodiester bonds. TNA polymers are resistant to nuclease degradation. TNA can self-assemble by base-pair hydrogen bonding into duplex structures.

Linkage inversions can be introduced into polynucleotides through use of "reversed phosphoramidites" (see, e.g., www.ucalgary.ca/dnalab/synthesis/-modifications/linkages). A 3'-3' linkage at a terminus of a polynucleotide stabilizes the polynucleotide to exonuclease degradation by creating an oligonucleotide having two 5'-OH termini but lacking a 3'-OH terminus. Typically, such polynucleotides have phosphoramidite groups on the 5'-OH position and a dimethoxytrityl (DMT) protecting group on the 3'-OH position. Normally, the DMT protecting group is on the 5'-OH and the phosphoramidite is on the 3'-OH.

Polynucleotide sequences are displayed herein in the conventional 5' to 3' orientation unless otherwise indicated.

As used herein, "sequence identity" generally refers to the percent identity of nucleotide bases or amino acids comparing a first polynucleotide or polypeptide to a second polynucleotide or polypeptide using algorithms having various weighting parameters. Sequence identity between two polynucleotides or two polypeptides can be determined using sequence alignment by various methods and computer programs (e.g., BLAST, CS-BLAST, PSI-BLAST, FASTA, HMMER, L-ALIGN, and the like) available through the worldwide web at sites including, but not limited to, GENBANK (www.ncbi.nlm.nih.gov/gtnbanIc/) and EMBL-EBI (www.ebi.ac.uk). Sequence identity between two polynucleotides or two polypeptide sequences is generally calculated using the standard default parameters of the various methods or computer programs. A high degree of sequence identity, as used herein, between two polynucleotides or two polypeptides is typically between about 90% identity and 100% identity, for example, about 90% identity or higher, preferably about 95% identity or higher, more preferably about 98% identity or higher. A moderate degree of sequence identity, as used herein, between two polynucleotides or two polypeptides is typically between about 80% identity to about 85% identity, for example, about 80% identity or higher, preferably about 85% identity. A low degree of sequence identity, as used herein, between two polynucleotides or two polypeptides is typically between about 50% identity and 75% identity, for example, about 50% identity, preferably about 60% identity, more preferably about 75% identity. For example, a Cas protein (e.g., Type I-E Cse2, Cas5, Cas6, Cas7, and/or Cas8) comprising amino acid substitutions can have a low degree of sequence identity, a moderate degree of sequence identity, or a high degree of sequence identity over its length to a reference Cas protein (e.g., wild-type Type I-E Cse2, Cas5, Cas6, Cas7, and/or Cas8, respectively). As another example, a guide polynucleotide can have a low degree of sequence identity, a moderate degree of sequence identity, or a high degree of sequence identity over its length compared with a reference wild-type guide polynucleotide that complexes with the reference Cas proteins (e.g., a guide polynucleotide that forms a complex with a Type I-E Cse2, Cas5, Cas6, Cas7, and/or Cas8).

As used herein, "hybridization" "hybridize," or "hybridizing" is the process of combining two complementary single-stranded DNA or RNA molecules so as to form a single double-stranded molecule (DNA/DNA, DNA/RNA, RNA/RNA) through hydrogen base pairing. Hybridization stringency is typically determined by the hybridization temperature and the salt concentration of the hybridization buffer; e.g., high temperature and low salt provide high stringency hybridization conditions. Examples of salt concentration ranges and temperature ranges for different hybridization conditions are as follows: high stringency, approximately 0.01M to approximately 0.05M salt, hybridization temperature 5"C to 10° C. below $T_m$; moderate stringency, approximately 0.16M to approximately 0.33M salt, hybridization temperature 20° C. to 29° C. below $T_m$; and low stringency, approximately 0.33M to approximately 0.82M salt, hybridization temperature 40"C to 48° C. below $T_m$. $T_m$ of duplex nucleic acid sequences is calculated by standard methods well known in the art (see, e.g., Maniatis, T., et al., Molecular Cloning: A Laboratory Manual, Cold Spring Harbor Laboratory Press: New York (1982); Casey, J., et al., Nucleic Acids Research 4:1539-1552 (1977); Bodkin, D. K., et al., Journal of Virological Methods 10(1): 45-52 (1985); Wallace, R. B., et al., Nucleic Acids Research 9(4):879-894 (1981)). Algorithm prediction tools to estimate $T_m$ are also widely available. High stringency conditions for hybridization typically refer to conditions under which a polynucleotide complementary to a target sequence predominantly hybridizes with the target sequence and substantially does not hybridize to non-target sequences. Typically, hybridization conditions are of moderate stringency, preferably high stringency.

As used herein, "complementarity" refers to the ability of a nucleic acid sequence to form hydrogen bond(s) with another nucleic acid sequence (e.g., through canonical Watson-Crick base pairing). A percent complementarity indicates the percentage of residues in a nucleic acid sequence that can form hydrogen bonds with a second nucleic acid sequence. If two nucleic acid sequences have 100% complementarity, the two sequences are perfectly complementary, i.e., all of the contiguous residues of a first polynucleotide hydrogen bond with the same number of contiguous residues in a second polynucleotide.

As used herein, "binding" refers to a non-covalent interaction between macromolecules (e.g., between a protein and a polynucleotide, between a polynucleotide and a polynucleotide, between a protein and a protein, and the like). Such non-covalent interaction is also referred to as "associating" or "interacting" (e.g., if a first macromolecule interacts with a second macromolecule, the first macromolecule binds to second macromolecule in a non-covalent manner). Some portions of a binding interaction may be sequence-specific (the terms "sequence-specific binding," "sequence-specifically bind," "site-specific binding," and "site specifically binds" are used interchangeably herein). Sequence-specific binding, as used herein, typically refers to one or more guide polynucleotides capable of forming a complex with Type I CRISPR-Cas subunit proteins (e.g., Cse2, Cas5, Cas6, Cas7, and Cas8) to cause the protein to bind a nucleic acid sequence (e.g., a DNA sequence) comprising a nucleic acid target sequence (e.g., a DNA target sequence) preferentially relative to a second nucleic acid sequence (e.g., a second DNA sequence) without the nucleic acid target binding sequence (e.g., the DNA target binding sequence). All components of a binding interaction do not need to be sequence-specific, such as contacts of a protein with phosphate residues in a DNA backbone. Binding interactions can be characterized by a dissociation constant (Kd). "Binding affinity" refers to the strength of the binding interaction. An increased binding affinity is correlated with a lower Kd.

As used herein, effector complexes are said to "target" a polynucleotide if such a complex binds or cleaves a polynucleotide in the nucleic acid target sequence within the polynucleotide.

As used herein, a "double-strand break" (DSB) refers to both strands of a double-stranded segment of DNA being severed. In some instances, if such a break occurs, one strand can be said to have a "sticky end" wherein nucleotides are exposed and not hydrogen bonded to nucleotides on the other strand. In other instances, a "blunt end" can occur wherein both strands remain fully base paired with each other.

"Donor polynucleotide," "donor oligonucleotide," and "donor template" are used interchangeably herein and can be a double-stranded polynucleotide (e.g., DNA), a single-stranded polynucleotide (e.g., DNA or RNA), or a combination thereof. Donor polynucleotides can comprise homology arms flanking the insertion sequence (e.g., DSBs in the DNA). The homology arms on each side can vary in length (e.g., 1-50 bases, 50-100 bases, 100-200 bases, 200-300 bases, 300-500 bases, 500-1000 bases). Homology arms can be symmetric or asymmetric in length. Parameters for the design and construction of donor polynucleotides are well known in the art (see, e.g., Ran, F., et al., Nature Protocols 8(11):2281-2308 (2013); Smithies, O., et al., Nature 317: 230-234 (1985); Thomas, K., et al., Cell 44:419-428 (1986); Wu, S., et al., Nature Protocols 3:1056-1076 (2008); Singer, B., et al., Cell 31:25-33 (1982); Shen, P., et al., Genetics 112:441-457 (1986); Watt, V., et al., Proceedings of the National Academy of Sciences of the United States of America 82:4768-4772 (1985); Sugawara, N., et al., Journal of Molecular Cell Biology 12(2):563-575 (1992); Rubnitz, J., et al., Journal of Molecular Cell Biology 4(11):2253-2258 (1984); Ayares, D., et al., Proceedings of the National Academy of Sciences of the United States of America 83(14):5199-5203 (1986); Liskay, R., et al., Genetics 115 (1):161-167 (1987)).

As used herein, "homology-directed repair" (HDR) refers to DNA repair that takes place in cells, for example, during repair of a DSB in genomic DNA. HDR requires nucleotide sequence homology and uses a donor or template polynucleotide to repair the sequence wherein the DSB (e.g., within a DNA target sequence) occurred. The donor polynucleotide generally has the requisite sequence homology with the sequence flanking the DSB so that the donor polynucleotide can serve as a suitable template for repair. HDR results in the transfer of genetic information from, for example, the donor polynucleotide to the DNA target sequence. HDR may result in alteration of the DNA target sequence (e.g., insertion, deletion, or mutation) if the donor polynucleotide sequence differs from the DNA target sequence and part or all of the donor polynucleotide is incorporated into the DNA target sequence. In some embodiments, an entire donor polynucleotide, a portion of the donor polynucleotide, or a copy of the donor polynucleotide is integrated at the site of the DNA target sequence. For example, a donor polynucleotide can be used for repair of the break in the DNA target sequence, wherein the repair results in the transfer of genetic information from the donor polynucleotide at the site or in close proximity of the break in the DNA. Accordingly, new genetic information may be inserted or copied at a DNA target sequence.

A "genomic region" is a segment of a chromosome in the genome of a host cell that is present on either side of the nucleic acid target sequence site or, alternatively, also includes a portion of the nucleic acid target sequence site. The homology arms of the donor polynucleotide have sufficient homology to undergo homologous recombination with the corresponding genomic regions. In some embodiments, the homology arms of the donor polynucleotide share significant sequence homology to the genomic region immediately flanking the nucleic acid target sequence site; it is recognized that the homology arms can be designed to have sufficient homology to genomic regions farther from the nucleic acid target sequence site.

As used herein, "non-homologous end joining" (NHEJ) refers to the repair of a DSB in DNA by direct ligation of one terminus of the break to the other terminus of the break without a requirement for a donor polynucleotide. NHEJ is a DNA repair pathway available to cells to repair DNA without the use of a repair template. NHEJ in the absence of a donor polynucleotide often results in nucleotides being randomly inserted or deleted at the site of the DSB.

"Microhomology-mediated end joining" (MMEJ) is pathway for repairing a DSB in genomic DNA. MMEJ involves deletions flanking a DSB and alignment of microhomologous sequences internal to the break site before joining. MMEJ is genetically defined and requires the activity of, for example, CtIP, Poly(ADP-Ribose) Polymerase 1 (PARP1), DNA polymerase theta (Pol A), DNA Ligase 1 (Lig 1), or DNA Ligase 3 (Lig 3). Additional genetic components are known in the art (see, e.g., Sfeir, A., et al., Trends in Biochemical Sciences 40:701-714 (2015)).

As used herein, "DNA repair" encompasses any process whereby cellular machinery repairs damage to a DNA molecule contained in the cell. The damage repaired can include ss-breaks or DSBs. At least three mechanisms exist to repair DSBs: HDR, NHEJ, and MMEJ. "DNA repair" is also used herein to refer to DNA repair resulting from human manipulation, wherein a target locus is modified, e.g., by inserting, deleting, or substituting nucleotides, all of which represent forms of genome editing.

As used herein, "recombination" refers to a process of exchange of genetic information between two polynucleotides.

As used herein, the terms "regulatory sequences," "regulatory elements," and "control elements" are interchangeable and refer to polynucleotide sequences that are upstream (5' non-coding sequences), within, or downstream (3' non-translated sequences) of a polynucleotide target to be expressed. Regulatory sequences influence, for example, the timing of transcription, amount or level of transcription, RNA processing or stability, and/or translation of the related structural nucleotide sequence. Regulatory sequences may include activator binding sequences, enhancers, introns, polyadenylation recognition sequences, promoters, transcription start sites, repressor binding sequences, stem-loop structures, translational initiation sequences, internal ribosome entry sites (IRES), translation leader sequences, transcription termination sequences (e.g., polyadenylation signals and poly-U sequences), translation termination sequences, primer binding sites, and the like.

Regulatory elements include those that direct constitutive, inducible, and repressible expression of a nucleotide sequence in many types of host cells and those that direct expression of the nucleotide sequence only in certain host cells (e.g., tissue-specific regulatory sequences). In some embodiments, a vector comprises one or more pol III promoters, one or more pol II promoters, one or more pol I promoters, or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer; see, e.g., Boshart, M., et al., Cell 41:521-530 (1985)), the SV40 promoter, the dihydrofolate reductase promoter, the β-actin promoter, the phosphoglycerol kinase (PGK) promoter, and the EF1α promoter. It will be appreciated by those skilled in the art that the design of an expression vector may depend on such factors as the choice of the host cell to be transformed, the level of expression desired, and the like. A vector can be introduced into host cells to thereby produce transcripts, proteins, or peptides, including fusion proteins or peptides, encoded by nucleic acid sequences as described herein.

"Gene," as used herein, refers to a polynucleotide sequence comprising exon(s) and related regulatory sequences. A gene may further comprise intron(s) and/or untranslated region(s) (UTR(s)).

As used herein, the term "operably linked" refers to polynucleotide sequences or amino acid sequences placed into a functional relationship with one another. For example, regulatory sequences (e.g., a promoter or enhancer) are "operably linked" to a polynucleotide encoding a gene product if the regulatory sequences regulate or contribute to the modulation of the transcription of the polynucleotide. Operably linked regulatory elements are typically contiguous with the coding sequence. However, enhancers can function if separated from a promoter by up to several kilobases or more. Accordingly, some regulatory elements may be operably linked to a polynucleotide sequence but not contiguous with the polynucleotide sequence. Similarly, translational regulatory elements contribute to the modulation of protein expression from a polynucleotide.

As used herein, "expression" refers to transcription of a polynucleotide from a DNA template, resulting in, for example, a messenger RNA (mRNA) or other RNA transcript (e.g., non-coding, such as structural or scaffolding RNAs). The term further refers to the process through which transcribed mRNA is translated into peptides, polypeptides, or proteins. Transcripts and encoded polypeptides may be referred to collectively as "gene product(s)." Expression may include splicing the mRNA in a eukaryotic cell, if the polynucleotide is derived from genomic DNA.

As used herein, the term "modulate" refers to a change in the quantity, degree or amount of a function. For example, a Type I CRISPR nucleoprotein complex, as disclosed herein, may modulate the activity of a promoter sequence by binding to a nucleic acid target sequence at or near the promoter or a transcriptional start site or regulator site. Depending on the action occurring after binding, the Type I CRISPR nucleoprotein complex can induce, enhance, suppress, or inhibit transcription of a gene operatively linked to the promoter sequence. Thus, "modulation" of gene expression includes both gene activation and gene repression.

Modulation can be assayed by determining any characteristic directly or indirectly affected by the expression of the target gene. Such characteristics include, for example, changes in RNA or protein levels, protein activity, product levels, expression of the gene, or activity level of reporter genes. Accordingly, the terms "modulating expression," "inhibiting expression," and "activating expression" of a gene can refer to the ability of a Type I CRISPR nucleoprotein complex to change, activate, or inhibit transcription of a gene.

"Vector" and "plasmid," as used herein, refer to a polynucleotide vehicle to introduce genetic material into a cell. Vectors can be linear or circular. Vectors can contain a replication sequence capable of effecting replication of the vector in a suitable host cell (e.g., an origin of replication). Upon transformation of a suitable host, the vector can replicate and function independently of the host genome or integrate into the host genome. Vector design depends, among other things, on the intended use and host cell for the vector, and the design of a vector of the invention for a particular use and host cell is within the level of skill in the art. The four major types of vectors are plasmids, viral vectors, cosmids, and artificial chromosomes. Typically, vectors comprise an origin of replication, a multicloning site, and/or a selectable marker. An expression vector typically comprises an expression cassette.

As used herein, "expression cassette" refers to a polynucleotide construct generated using recombinant methods or by synthetic means and comprising regulatory sequences operably linked to a selected polynucleotide to facilitate expression of the selected polynucleotide in a host cell. For example, the regulatory sequences can facilitate transcription of the selected polynucleotide in a host cell, or transcription and translation of the selected polynucleotide in a host cell. An expression cassette can, for example, be integrated in the genome of a host cell or be present in a vector to form an expression vector.

As used herein, a "targeting vector" is a recombinant DNA construct typically comprising tailored DNA arms, homologous to genomic DNA, that flank elements of a target gene or nucleic acid target sequence (e.g., a DSB). A targeting vector comprises a donor polynucleotide. Elements of the target gene can be modified in a number of ways, including deletions and/or insertions. A defective target gene can be replaced by a functional target gene, or in the alternative a functional gene can be knocked out. Optionally, the donor polynucleotide of a targeting vector comprises a selection cassette comprising a selectable marker that is introduced into the target gene. Targeting regions adjacent or within a target gene can be used to affect regulation of gene expression.

As used herein, the term "between" is inclusive of end values in a given range (e.g., between 1 and 50 nucleotides in length includes 1 nucleotide and 50 nucleotides; between 5 amino acids and 50 amino acids in length includes 5 amino acids and 50 amino acids).

As used herein, the term "amino acid" (aa) refers to natural and synthetic (unnatural) amino acids, including amino acid analogs, modified amino acids, peptidomimetics, glycine, and D or L optical isomers.

As used herein, the terms "peptide," "polypeptide," "protein," and "subunit protein" are interchangeable and refer to polymers of amino acids. A polypeptide may be of any length. It may be branched or linear, it may be interrupted by non-amino acids, and it may comprise modified amino acids. The terms also refer to an amino acid polymer that has been modified through, for example, acetylation, disulfide bond formation, glycosylation, lipidation, phosphorylation, pegylation, biotinylation, cross-linking, and/or conjugation (e.g., with a labeling component or ligand). Polypeptide sequences are displayed herein in the conventional N-terminal to C-terminal orientation, unless otherwise indicated.

Polypeptides and polynucleotides can be made using routine techniques in the field of molecular biology (see, e.g., standard texts discussed above). Furthermore, essentially any polypeptide or polynucleotide is available from commercial sources.

The terms "fusion protein" and "chimeric protein," as used herein, refer to a single protein created by joining two or more proteins, protein domains, or protein fragments or circular permuted polypeptides that do not naturally occur together in a single protein. In some embodiments, a linker polynucleotide can be used to connect a first protein, protein domains, or protein fragments, or circular permuted polypeptides to a second protein, protein domains, or protein fragments or circular permuted polypeptides. For example, a fusion protein can comprise a Type I CRISPR-Cas protein (e.g., Cas8, Cas3) and a functional domain from another protein (e.g., FokI; see, e.g., U.S. Pat. No. 9,885,026, issued 6 Feb. 2018). The modification to include such domains in fusion proteins may confer additional activity on engineered Type I CRISPR-Cas proteins. Such activities can include nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, glycosylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, and/or myristoylation activity or demyristoylation activity that modifies a polypeptide associated with nucleic acid target sequence (e.g., a histone).

In some embodiments, a fusion protein can comprise epitope tags (e.g., histidine tags, HA tags, FLAG® (Sigma Aldrich, St. Louis, Mo.) tags, Myc tags, nuclear localization signal (NLS) tags, SunTag), reporter protein sequences (e.g., glutathione-S-transferase, beta-galactosidase, luciferase, green fluorescent protein, cyan fluorescent protein, yellow fluorescent protein), and/or nucleic acid sequence binding domains (e.g., a DNA binding domain or an RNA binding domain).

A fusion protein can also comprise activator domains (e.g., heat shock transcription factors, NFKB activators) or repressor domains (e.g., a KRAB domain). As described by Lupo, A., et al., Current Genomics 14(4):268-278 (2013), the KRAB domain is a potent transcriptional repression module and is located in the amino-terminal sequence of most C2H2 zinc finger proteins (see, e.g., Margolin, J., et al., Proceedings of the National Academy of Sciences of the United States of America 91:4509-4513 (1994); Witzgall, R., et al., Proceedings of the National Academy of Sciences of the United States of America 91:4514-4518 (1994)). The KRAB domain typically binds to co-repressor proteins and/or transcription factors via protein-protein interactions, causing transcriptional repression of genes to which KRAB zinc finger proteins (KRAB-ZFPs) bind (see, e.g., Friedman J. R., et al., Genes & Development 10:2067-2678 (1996)). In some embodiments, linker nucleic acid sequences are used to join the two or more proteins, protein domains, or protein fragments.

As used herein "CASCADEa" (Cascade activation) is a CRISPR method or system wherein the method or system activates the expression of a gene within the locus of the target nucleic acid sequence. For the recruitment of endogenous transcription factors, one or more subunit proteins in a Cascade complex and/or the guide polynucleotide is typically fused to an effector domain (e.g., VP16 or VP64). In some embodiments, the guide polynucleotide can be fused 5' or 3' to a nucleotide effector domain such as an MS2 binding RNA that also recruits transcription factors. Fusions comprising one or more Cascade subunit proteins and the guide polynucleotide can be combined.

As used herein "CASCADEi" (Cascade inhibition) is a CRISPR method or system wherein the CRISPR method or system downregulates the expression of a gene within the locus of the target nucleic acid sequence. For the recruitment of endogenous repression factors, one or more subunit proteins in a Cascade complex and/or the guide polynucleotide is typically fused to an effector domain (e.g., KRAB). In some embodiments, the guide polynucleotide can be fused 5' or 3' to a nucleotide effector domain that also recruits transcription factors. Fusions comprising one or more Cascade subunit proteins and the guide polynucleotide can be combined.

A "moiety," as used herein, refers to a portion of a molecule. A moiety can be a functional group or describe a portion of a molecule with multiple functional groups (e.g., that share common structural aspects). The terms "moiety" and "functional group" are typically used interchangeably; however, a "functional group" can more specifically refer to a portion of a molecule that comprises some common chemical behavior.

The term "affinity tag," as used herein, typically refers to one or more moieties that increases the binding affinity of one macromolecule for another, for example, to facilitate formation of an engineered Type I CRISPR-Cas nucleoprotein complex. In some embodiments, an affinity tag can be used to increase the binding affinity of one Cas subunit protein for another Cas subunit protein (e.g., a first Cas7 protein for a second Cas7 protein). In some embodiments, an affinity tag can be used to increase the binding affinity of one or more Cas subunit proteins for a cognate guide polynucleotide. Some embodiments of the present invention introduce one or more affinity tags to the N-terminal of a Cas subunit protein sequence, to the C-terminal of a Cas subunit protein sequence, to a position located between the N-terminal and C-terminal of a Cas subunit protein sequence, or to combinations thereof. In some embodiments of the present invention, one or more guide polynucleotide comprises an affinity tag that increases binding affinity of the guide polynucleotide with one or more Cas subunit proteins. A wide variety of affinity tags are disclosed in U.S. Published Patent Application No. 2014-0315985, published 23 Oct. 2014. Ligands and ligand-binding moieties are paired affinity tags.

As used herein, a "cross-link" is a bond that links one polymer chain (e.g., a polynucleotide or polypeptide) to another. Such bonds can be covalent bonds or ionic bonds. In some embodiments, one polynucleotide can be bound to another polynucleotide by cross linking the polynucleotides. In other embodiments, a polynucleotide can be cross linked to a polypeptide. In additional embodiments, a polypeptide can be cross linked to a polypeptide.

The term "cross-linking moiety," as used herein, typically refers to a moiety suitable to provide cross linking between two macromolecules. A cross-linking moiety is another example of an affinity tag.

As used herein, a "host cell" generally refers to a biological cell. A cell is the basic structural, functional, and/or biological unit of an organism. A cell can originate from any organism having one or more cells. Examples of host cells include, but are not limited to, a prokaryotic cell, eukaryotic cell, a bacterial cell, an archaeal cell, a cell of a single-cell eukaryotic organism, a cell of a eukaryotic organism, a protozoal cell, a cell from a plant (e.g., cells from plant crops (such as soy, tomatoes, sugar beets, pumpkin, hay, *cannabis*, tobacco, plantains, yams, sweet potatoes, cassava, potatoes, wheat, sorghum, soybean, rice, corn, maize, oil-producing *Brassica* (e.g., oil-producing rapeseed and canola), cotton, sugar cane, sunflower, millet, and alfalfa), fruits, vegetables, grains, seeds, flowering plants, conifers, gymnosperms, ferns, clubmosses, hornworts, liverworts, mosses), an algal cell, (e.g., *Botryococcus braunii, Chlamydomonas reinhardtii, Nannochloropsis gaditana, Chlorella pyrenoidosa, Sargassum patens C. agardh*, and the like), seaweeds (e.g., kelp), a fungal cell (e.g., a yeast cell or a cell from a mushroom), an animal cell, a cell from an invertebrate animal (e.g., fruit fly, cnidarian, echinoderm, nematode, and the like), a cell from a vertebrate animal (e.g., fish, amphibian, reptile, bird, or mammal), a cell from a mammal (e.g., a pig, a cow, a goat, a sheep, a rodent, a rat, a mouse, a non-human primate, a human, and the like). Furthermore, a cell can be a stem cell or a progenitor cell. In some embodiments, a host cell is a non-human cell. In some embodiments, a host cell is a human cell outside of a human body, wherein in particular embodiments the human cell is not introduced into a human body.

As used herein, "stem cell" refers to a cell that has the capacity for self-renewal, i.e., the ability to go through numerous cycles of cell division while maintaining the undifferentiated state. Stem cells can be totipotent, pluripotent, multipotent, oligopotent, or unipotent. Stem cells can be embryonic, fetal, amniotic, adult, or induced pluripotent stem cells.

As used herein, "induced pluripotent stem cell" refers to a type of pluripotent stem cell that is artificially derived from a non-pluripotent cell, typically a somatic cell. In some embodiments, the somatic cell is a human somatic cell. Examples of somatic cells include, but are not limited to, dermal fibroblasts, bone marrow-derived mesenchymal cells, cardiac muscle cells, keratinocytes, liver cells, stomach cells, neural stem cells, lung cells, kidney cells, spleen cells, and pancreatic cells. Additional examples of somatic cells include cells of the immune system, including but not limited to, B cells, dendritic cells, granulocytes, innate lymphoid cells, megakaryocytes, monocytes/macrophages, myeloid-derived suppressor cells, natural killer (NK) cells, T cells, thymocytes, and hematopoietic stem cells.

"Plant," as used herein, refers to whole plants, plant organs, plant tissues, germplasm, seeds, plant cells, and progeny of the same. Plant cells include, without limitation, cells from seeds, suspension cultures, embryos, meristematic regions, callus tissue, leaves, roots, shoots, gametophytes, sporophytes, pollen, and microspores. Plant parts include differentiated and undifferentiated tissues including, but not limited to, roots, stems, shoots, leaves, pollens, seeds, tumor tissue, and various forms of cells and culture (e.g., single cells, protoplasts, embryos, and callus tissue). The plant tissue may be in plant or in a plant organ, tissue, or cell culture. "Plant organ" refers to plant tissue or a group of tissues that constitute a morphologically and functionally distinct part of a plant.

"Subject," as used herein, refers to any member of the phylum Chordata, including, without limitation, humans and other primates, including non-human primates such as rhesus macaques, chimpanzees, and other monkey and ape species; farm animals, such as cattle, sheep, pigs, goats, and horses; domestic mammals, such as dogs and cats; laboratory animals, including rabbits, mice, rats, and guinea pigs; birds, including domestic, wild, and game birds, such as chickens, turkeys and other gallinaceous birds, ducks, and geese; and the like. The term does not denote a particular age or gender. Thus, the term includes adult, young, and newborn individuals as well as male and female. In some embodiments, a host cell is derived from a subject (e.g., stem cells, progenitor cells, or tissue-specific cells). In some embodiments, the subject is a non-human subject.

As used herein, "transgenic organism" refers to an organism that contains genetic material into which DNA from an unrelated organism has been artificially introduced. The term includes the progeny (any generation) of a transgenic organism, provided that the progeny has the genetic modification. In some embodiments, the transgenic organism is a non-human transgenic organism.

As used herein, "isolated" can refer to a molecule (e.g., a polynucleotide or a polypeptide) that, by human intervention, exists apart from its native environment and is therefore not a product of nature. An isolated polynucleotide or polypeptide can exist in a purified form and/or can exist in a non-native environment such as, for example, in a recombinant cell.

As used herein, a "substrate channel" refers to the direct transfer of a reactant from one enzymatic reaction to another enzymatic reaction without first diffusing into the bulk environment (Wheeldon, I., et al., Nat. Chem. 8(4):299-309 (2016)). Intermediates of these enzymatic steps are not in equilibrium with the bulk solution, which enables the increased efficiencies and yields in enzymatic processes. Frequently, enzymes in naturally occurring metabolic processes have evolved means of co-localization and assembly into controlled aggregates.

As used herein, "substrate channel element" refers to a component of a metabolic pathway. In some embodiments, a substrate channel element is an enzyme that catalyzes a chemical reaction.

As used herein, "substrate channel complex" refers to multiple substrate channel elements that are co-localized together via some means.

As used herein, an "RNA scaffold" refers to an RNA molecule that peptides can use as a substrate for binding.

In a first aspect, the present invention relates to engineered polynucleotides encoding Cascade components including, but not limited to, Cascade subunit proteins and Cascade guide polynucleotides.

In one embodiment, the present invention relates to engineered polynucleotides encoding Cascade components that are derived from Cascade Type I-E systems. Exemplary polynucleotide constructs comprising Cascade proteins and Cascade crRNAs are presented in Example 1. Example 1, Table 10, and SEQ ID NO:1 through SEQ ID NO:20 (FIG. 3) present polynucleotide DNA sequences of genes encoding the five subunit proteins of Type I-E Cascade, specifically from E. coli strain K-12 MG1655, as well as the amino acid sequences of the resulting protein components. The polynucleotide sequences were derived from E. coli genomic DNA and were codon optimized specifically for expression in E. coli, and/or codon optimized specifically for expression in eukaryotic cells (e.g., human cells). When this polynucleotide is transcribed into a precursor crRNA and processed by the Cascade RNA endonuclease, a mature crRNA is produced that functions as a guide RNA to target complementary DNA sequences in the genome. The minimal CRISPR array comprises two repeat sequences (underlined in the CRISPR array sequences presented in Example 1) flanking an exemplary spacer sequence, which represents the guide portion of the crRNA. RNA processing by the Cascade endonuclease generates a crRNA with repeat sequences on both the 5' and 3' ends, flanking the guide sequence. One of ordinary skill in the art, in view of the teachings of the present Specification and the Examples, can select appropriate spacer sequences to target binding of a Cascade complex to a chosen target sequence (e.g., in genomic DNA).

Polynucleotide sequences encoding Cascade components from additional bacterial or archaeal species can be identified and designed following the guidance of the present Specification and using bioinformatics tools such as BLAST and PSI-BLAST to locate, as an example, homologs of Cascade subunit genes from E. coli strain K-12 MG1655, and then inspecting the flanking genomic neighborhood of the Cascade gene to locate and identify genes of the remaining Cascade subunit proteins (see, e.g., Example 14, Example 15). Because Cascade genes co-occur as conserved operons, they are typically arranged in a consistent order, within the same Type I subtype, facilitating their identification and selection for follow-up analysis and experimentation. As an example, additional Type I-E systems can be identified by locating Cas8 homologs, identifying promising bacterial species for homologous Cascade testing, and then obtaining or designing polynucleotide sequences encoding the Cas8 and other protein components of the Cascade from those homologous CRISPR-Cas systems.

Polynucleotide DNA sequences of genes encoding the five subunit proteins of Cascade from twelve species (these species are listed in Table 2) with Cascade complexes homologous to those derived from E. coli strain K-12 MG1655, and the amino acid sequences of the resulting protein components, as well as exemplary minimal CRISPR arrays, are presented as SEQ ID NO:22 through SEQ ID NO:213 (FIG. 3). The polynucleotide sequences for the proteins were derived from the genomic DNA of the host bacterium, and were codon optimized specifically for expression in E. coli, and/or codon optimized specifically for expression in eukaryotic cells (e.g., human cells). The polynucleotide DNA sequences encoding corresponding minimal CRISPR arrays were based on repeat sequences derived from the 12 species and can be used to generate mature crRNA that function as guide RNAs. In Table 2, the minimal CRISPR array comprises two repeat sequences (lower case, underlined) flanking an exemplary "spacer" sequence, which represents the guide portion of the crRNA. RNA processing by the endonuclease Cascade subunit generates a crRNA with repeat sequences on both the 5' and 3' ends, flanking the guide sequence.

TABLE 2

Minimal CRISPR Arrays

| SEQ ID NO: | Species | Minimal CRISPR repeat |
|---|---|---|
| SEQ ID NO: 37 | I-E_Oceanicola sp. HL-35 | ctgttccccgcacacgcggggatgaaccgGGTTCT TCGATCTGCGCATCCATGATGCCGC Cctgttccccgcacacgcggggatgaaccg |
| SEQ ID NO: 53 | I-E_Pseudomonas sp. S-6-2 | gtgttccccgcacctgcggggatgaaccGGGCCG GGGCGTTTGCGCTGTCAGGGGCGT CCCgtgttccccgcacctgcggggatgaaccg |
| SEQ ID NO: 69 | I-E_Salmonella enterica subsp. enterica serovar Muenster strain | gtgttccccgcgccagcggggataaaccgCAGCTT TAGCATCGGTCGACAGCCCATCTG GCgtgttccccgcgccagcggggataaaccg |
| SEQ ID NO: 85 | I-E_Atlantibacter hermannii NBRC 105704 | gtgttccccgcgccagcggggataaaccgTTTTAA AACAGGATGTGGCCCGCCTGGTGC TGgtgttccccgcgccagcggggataaaccg |
| SEQ ID NO: 101 | I-E_Geothermobacter sp. EPR-M | ctgttccccgcacccgcggggatgaaccgGTCATC TATTTTTAATGGACGATATTTTCA Actgttccccgcacccgcggggatgaaccg |
| SEQ ID NO: 117 | I-E_Methylocaldum sp. 14B | ctgttcccacgtacgtggggatgaaccgACGGCG TAATGGTAATTGTTAGCCGACAAG TTctgttcccacgtacgtggggatgaaccg |
| SEQ ID NO: 133 | I-E_Methanocella arvoryzae MRE50 | aaagtccccacaggcgtgggggtgaaccgTGATC AGTAACCCGGTCACCATTAAACAG ATTaaagtccccacaggcgtgggggtgaaccg |
| SEQ ID NO: 149 | I-E_Lachnospiraceae bacterium KH1T2 | gtattccccacgcacgtggrggtaaatcCGCTGAGg TTTAATTACGCAGCGGAAGCCGGA GCGgtattccccacgcacgtggggtaaatc |
| SEQ ID NO: 165 | I-E_Klebsiella pneumoniae strain VRCO0172 | gtcttccccacacgcgtgggggtgttcCGGCTCTT TTTTATCTCCTTCATCCTTCGCTATgt cttccccacacgcgtgggggtgtttc |
| SEQ ID NO: 181 | I-E_Pseudomonas aeruginosa DHS01 | gtgttcccacatgcgtggggatgaaccgGGCACC ATCGGCGCCATTGACCGCGCGCTG AAGgtgttcccacatgcgtggggatgaaccg |
| SEQ ID NO: 197 | I-E_Streptococcus thermophilus strain ND07 | gttttccgcacacgcgggggtgatccTATACCT ATATCAATGGCCTCCCACGCATAA |
| SEQ ID NO: 213 | I-E_Streptomyces sp. S4 | GCgttttccgcacacgcggggtgatcc gtcggccccgcacccgcggggatgctccAATGGC CGAGGACGACGGCGATCTGGCCAC GGACgtcggccccgcacccgcggggatgctcc |

In another embodiment, the present invention relates to engineered polynucleotide sequences encoding Cascade components from additional bacterial or archaeal species, within other Type I subtypes; including, but not limited, to Types I-B, I-C, I-F, and variants of I-F, which can be identified and designed following the guidance of the present Specification and by using bioinformatics tools such as BLAST and PSI-BLAST to locate homologs of Cascade genes from hallmark systems typifying each subtype (see, e.g., Makarova, K. S., et al., Nat. Rev. Microbiol. 13(11): 722-736 (2015); Koonin, E. V., et al., Curr Opin Microbiol. 37:67-78 (2017)). After identifying desirable homologs, the flanking genomic neighborhoods of the Cascade gene can be inspected to locate and identify genes of the remaining Cascade subunit proteins as disclosed herein. As an example, additional Type I-F systems can be identified by locating Cas8 homologs (and additional Type I-F variant 2 systems can be identified by locating Cas5 homologs) and identifying promising bacterial species for homologous Cascade testing, and then obtaining or designing polynucleotide sequences encoding the Cas8, Cas5, and other protein components of the Cascade from those homologous CRISPR-Cas systems.

Polynucleotide DNA sequences of genes encoding the three, four, or five subunit proteins of Cascade from Types I-B, I-C, I-F, and I-F variant 2 from twelve additional homologous Cascade complexes, and the amino acid sequences of the resulting protein components, as well as exemplary minimal CRISPR arrays, are presented as SEQ ID NO:214 through SEQ ID NO:351 (FIG. 3). The polynucleotide sequences for the subunit proteins were derived from the genomic DNA of the host bacterium, and were codon optimized specifically for expression in E. coli, and/or codon optimized specifically for expression in eukaryotic cells (e.g., human cells). The polynucleotide DNA sequences encoding corresponding minimal CRISPR arrays were based on repeat sequences derived from the twelve species and can be used to generate mature crRNA that function as guide RNAs. In Table 3 the minimal CRISPR array comprises two repeat sequences (lower case, underlined) flanking an exemplary "spacer" sequence, which represents the guide portion of the crRNA. RNA processing by the endonuclease Cascade subunit generates a crRNA with repeat sequences on both the 5' and 3' ends, flanking the guide sequence.

TABLE 3

Minimal CRISPR Arrays

| SEQ ID NO: | Species | Minimal CRISPR repeat |
|---|---|---|
| SEQ ID NO: 226 | I-B_Fusobacterium nucleatum subsp. animalis 3_1_33 | atgaactgtaaacttgaaaagttttgaaatGTTGACAAATATTCAGATAATTTTTCAAAATCTTTTatgaactgtaaacttgaaaagttttgaaat |
| SEQ ID NO: 239 | I-B_Campylobacter fetus subsp. testudinum Sp3 | gttttgctaatgacaatatttgtgttaaaacAAGCGTAGCACCAAAAGAAGCGTATGAAAGCATAGgttttgctaatgacaatatttgtgttaaaac |
| SEQ ID NO: 252 | I-B_Odoribacter splanchnicus DSM 20712 | cttttaattgaactaaggtagaattgaaacTAGGAATAAACCGTACCCAACCACGTAGCCATATACGcttttaattgaactaaggtagaattgaaac |
| SEQ ID NO: 262 | I-C_Bacillus halodurans C-125 | gtcgcactatcatgggtgcgtggattgaaatCCTTTGACGGAGAGGGGAACAGGAAATTAGAGAAGgtcgcactcttcatgggtgcgtggattgaaat |
| SEQ ID NO: 272 | I-C_Desulfovibrio vulgaris RCH1 plasmid pDEVAL01 | gtcgcccccacgcgggggcgtggattgaaacCAGTCTCGTTACCCTGTCGCGGAGGGCGTCGATgtcgcccccacgcgggggcgtggattgaaac |
| SEQ ID NO: 282 | I-C_Geobacillus thermocatenulatus strain KCTC 3921 | gttgcacccggctattaagccgggtgaggattgaaacTATATCACACAGCTTCTTAGTATCATCGACAACACGTgttgcacccggctattaagccgggtgaggattgaaac |
| SEQ ID NO: 295 | I-F_Vibrio cholerae strain L15 | gttcactgccgtacaggcagcttagaaaAATATGCAGGGGTTTGAAACGCTCGATGTTATgttcactgccgtacaggcagcttagaaa |
| SEQ ID NO: 308 | I-F_Klebsiella oxytoca strain ICU1-2b | gttcactgccgtacaggcagcttagaaaAAAAACTGAGCGGCCGCAGAATGAAGTTGTAAgttcactgccgtacaggcagcttagaaa |
| SEQ ID NO: 321 | I-F_Pseudomonas aeruginosa UCBPP-PA14 | gttcactgccgtgtaggcagctaagaaaACCACCCGCTACCACCGGCAGCCGCACCGGCCgttcactgccgtgtaggcagctaagaaa |
| SEQ ID NO: 331 | I-FV2_Shewanella putrefaciens CN-32 | gttcaccgccgcacaggcggcttagaaaTCAACCAAATCATAAATTGCGCGACCACATTGgttcaccgccgcacaggcggcttagaaa |
| SEQ ID NO: 341 | I-Fv2 Acinetobacter sp. 86955 | gttcactgccatataggcagatagaaaATCGTTTTTTCATACGAGATTCGAAACGGACAgttcactgccatataggcagcttagaaa |
| SEQ ID NO: 351 | I-Fv2_Vibrio cholerae HE48 | gttcactgccgcacaggcagcttagaaaTAACCGGAGGCGTACACTCGATAGAGGCAGCGgttcactgccgcacaggcagcttagaaa |

Example 19 describes the design and testing of multiple Cascade complex homologs, each comprising a Cas subunit protein-FokI fusion protein, to evaluate the efficiency of genome editing for each Cascade complex.

In a second aspect, the present invention relates to modified Cascade subunit proteins. Cascade subunit proteins suitable for modification include, but are not limited to, Cascade subunit proteins of the species described herein.

In one embodiment, the present invention relates to engineered circular permutations of Cascade subunit proteins. Such circular permutations of a Cascade subunit protein result in a protein structure having different connectivity of the original linear sequence of amino acids of the Cascade subunit protein, but having an overall similar three-dimensional shape (see, e.g., Bliven, S., et al., PLoS Comput. Biol. 8(3):e1002445 (2012)). Circular permutations of Cascade subunit proteins can have a number of advantages. For example, a circular permutation of a Cas7 subunit protein can create a new N-terminus and a new C-terminus designed to be positioned for connection with an additional polypeptide sequence to form a fusion protein or linker region without disturbing the Cas7 protein fold or the Cascade complex assembly. Three examples of circular permutations of Cas7 (circularly permuted Cas7, cpCas7) are illustrated in FIG. 4A and FIG. 4B. In FIG. 4A and FIG. 4B, three portions of the protein are shown: a N-terminal portion of the native protein (vertical stripes), a central portion of the native protein (grey shading), and a C-terminal portion of the native protein (no shading). FIG. 4A illustrates relocation of a N-terminal portion of the native protein to the C-terminal position of the cpCas7, wherein the N-terminal portion of the native protein is now at the N-terminal end of the cpCas7 and is connected to the central portion of the native protein by a linker polypeptide. FIG. 4B illustrates relocation of a C-terminal portion of the native protein to the N-terminal position of the cpCas7, wherein the C-terminal portion of the native protein is now at the N-terminal end of the cpCas7 and is connected to the central portion of the native protein by a linker polypeptide.

The data in Example 10 show that purification of Cascade complexes comprising circularly-permuted Cas7 subunit protein variants demonstrate that circularly-permuted Type I-E CRISPR-Cas subunit proteins can be successfully used to form Cascade complexes having essentially the same composition (based on molecular weight) as Cascade complexes comprising wild-type proteins.

In another embodiment, the present invention relates to Cascade subunit proteins fused to additional polypeptide sequences to create fusion proteins, as well as polynucleotides encoding such fusion proteins. Additional polypeptide sequences can include, but are not limited to, proteins, protein domains, protein fragments, and functional domains. Examples of such additional polypeptide sequences include, but are not limited to, sequences derived from transcription activator or repressor domains, and nucleotide deaminases (e.g., a cytidine deaminase or an adenine deaminase such as described in Komor et. al., Nature 553:420-424 (2016); Koblan et. al., Nat Biotechnol. 2018 May 29-doi: 10.1038/nbt.4172). Additional functional domains for fusion proteins are presented herein.

An additional polypeptide sequence can be fused to any of the Cascade subunit proteins wherein the additional polypeptide sequence is encoded by an additional polynucleotide sequence that is typically appended to either the 5' or 3' end of a polynucleotide comprising the coding sequence of a Cascade subunit protein. In some embodiments, additional polynucleotide sequences that encode amino acid linkers connect a Cascade subunit protein to the additional polypeptide sequences of interest. In some embodiments, the polynucleotide sequences for the fusion protein partner and the linker sequence can be derived from naturally occurring genomic DNA sequences or may be codon optimized for bacterial expression in *E. coli* or eukaryotic expression in mammalian cells (e.g., human cells). Examples of fusions proteins comprising affinity tags (e.g., His6, Strep-Tag® II (IBA GMBH LLC, Göttingen, Germany)), nuclear localization signal or sequence (NLS), maltose binding protein, and FolkI are presented in Example 1. Exemplary amino acid linker sequences are also disclosed in Example 1.

Example 11 describes Cascade subunit protein-FokI fusions, as well as Cascade subunit protein fusions to cytidine deaminases, endonucleases, restriction enzymes, a nuclease/helicase, or domains thereof. Example 11 describes Cascade subunit protein fusions with other Cascade subunit proteins, as well as Cascade subunit protein fusions with other Cascade subunit fusion proteins and an enzymatic protein domain. In some embodiments, a Type I CRISPR subunit protein can be evaluated in silico for the ability to be used to generate protein fusions at the N-terminus, C-terminus, or positions between the N-terminus and the C-terminus. In some embodiments, a Type I CRISPR subunit protein can be linked to one or more fusion domains at the N-terminus, C-terminus, or positions between the N-terminus and the C-terminus using one or more polypeptide linkers. Examples of polypeptide linkers are set forth in Examples 1, 11, 18, and 19.

FIG. 5A and FIG. 5B illustrate Cascade complexes comprising a Cas8 subunit protein fused to an additional protein sequence (e.g., a FolkI). FIG. 5A shows an example of the additional protein sequence ("FP") connected with the C-terminus of a Cas8 subunit protein using a linker polypeptide. FIG. 5B shows an example of the additional protein sequence ("FP") connected with the N-terminus of a Cas8 subunit protein using a linker polypeptide. Example 11A describes in silico design, cloning, expression, and purification of a Type I-E Cas8 fused N-terminally with a FolkI nuclease domain.

Figure 6B:
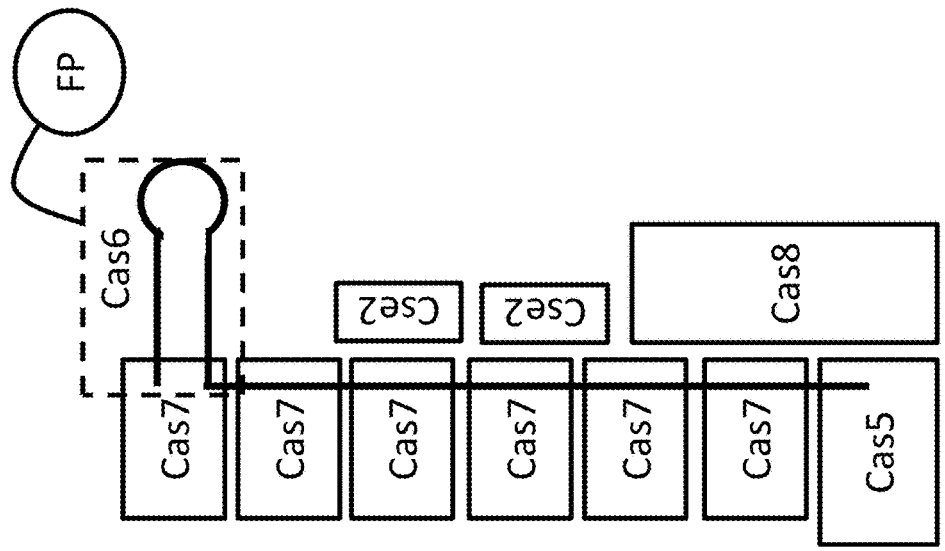
Figure 6A:
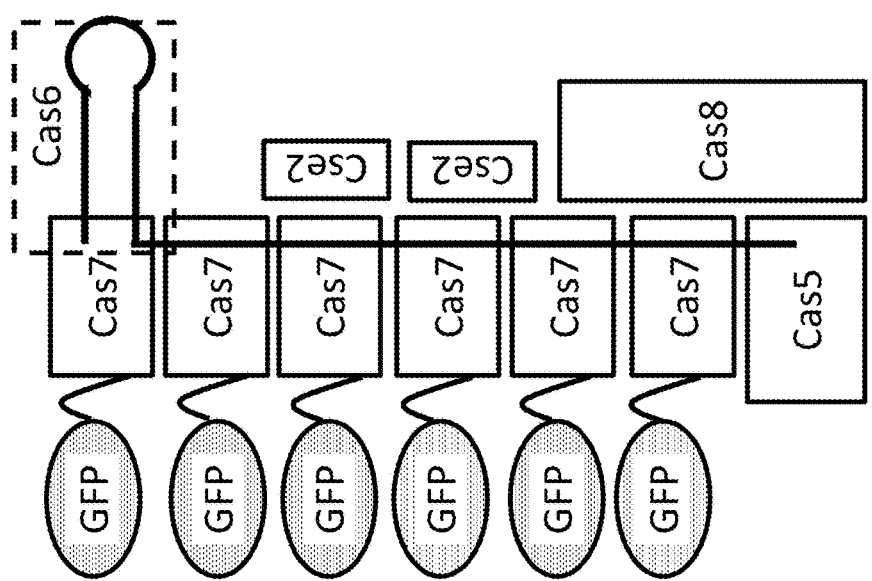

FIG. 6A and FIG. 6B illustrate additional examples of Cascade complexes comprising a Cascade subunit protein fused to an additional protein sequence. FIG. 6A shows an example of a detectable moiety (e.g., a green fluorescent protein, GFP) fused to each of six Cas7 subunit proteins, each via a linker polypeptide. Such a Cascade complex can be useful for detection of binding of the complex to a nucleic acid target sequence by providing significant signal amplification as a result of the presence of the multiple detectable moieties associated with the Cascade complex. FIG. 6B shows an example of an additional protein sequence ("FP") connected with Cas6 subunit protein using a linker polypeptide.

Examples of fusion proteins containing *E. coli* Type I-E Cascade subunit proteins include, but are not limited to, the following: the same subunit (e.g., Cse2_linker_Cse2), circularly permuted subunits (e.g., cpCas7_linker_ cpCas7_linker_cpCas7_linker_cpCas7_linker_cpCas7_ linker_cpCas7), a Type I-E Cascade protein fused to a nuclease (e.g., FokI_linker_Cas8, Cas3_linker_Cas8, Cas6_linker_FokI, S1Nuclease_linker_Cse2_linker_Cse2), a Type I-E Cascade protein fused to a cytidine deaminase (e.g., Cas8_linker_AID, Cse2_linker_Cse2_linker_ APOBEC3G), and a Type I-E Cascade protein fused one or more other Type I-E Cascade proteins (e.g., Cas6_ linker_cpCas7_linker_cpCas_7_linker_cpCas_7_linker_cp Cas_7_linker_cpCas_7_linker_cpCas7, cpCas_7_linker cpCas7_linker_cpCas7_ linker_cpCas7_ linker_cpCas7_ linker_cpCas7_linker_Cas5, Cas_6_linker_cpCas_7_ linker_cp Cas_7_linker_cpCas_7_linker_cpCas7_linker_ cp Cas7_linker_cp Cas7_linker_Cas5).

Figure 7C:
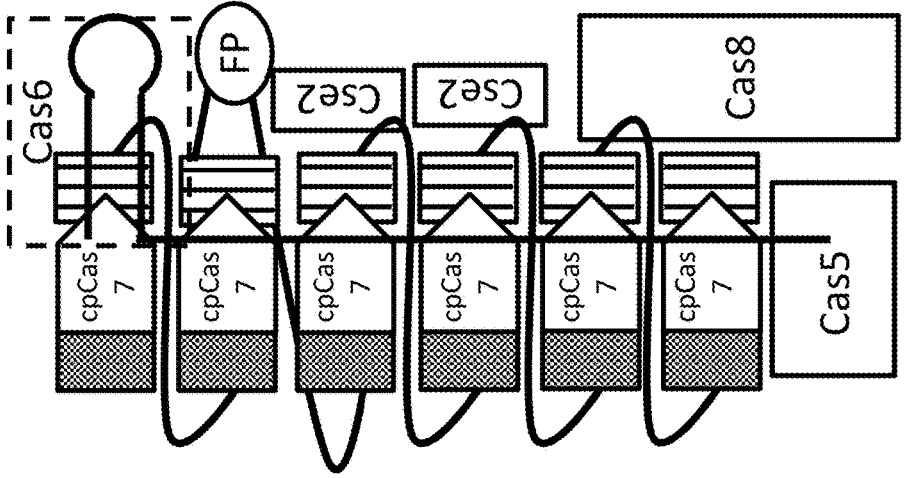
Figure 7B:
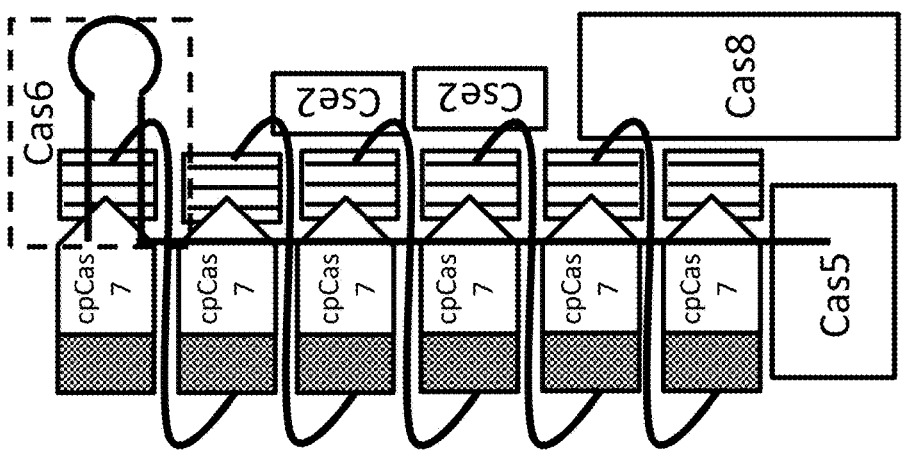
Figure 7A:
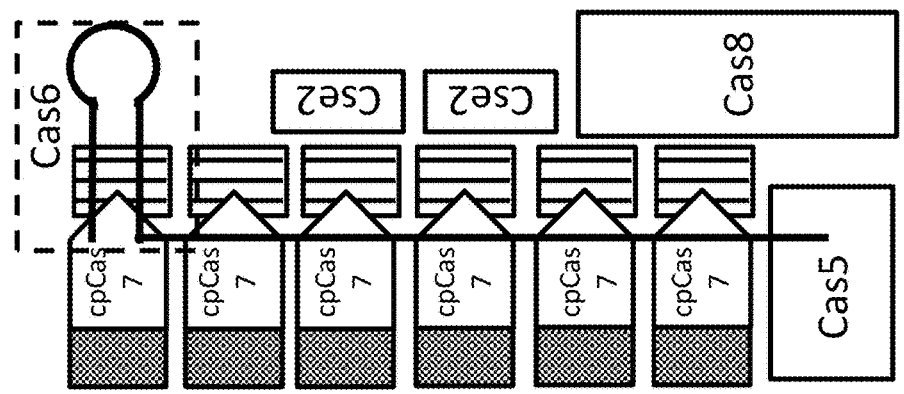

FIG. 7A, FIG. 7B, and FIG. 7C present illustrations of modified Type I CRISPR-Cas effector complexes that contain cpCas7 (compare FIG. 4A)). FIG. 7A presents a Cascade complex comprising six individual cpCas7 subunit proteins. FIG. 7B presents a Cascade complex comprising six fused cpCas7 subunit proteins, wherein the C-terminus of a cpCas7 subunit protein is connected with the N-terminus of an adjacent cpCas7 subunit protein using a linker polypeptide. FIG. 7C presents an embodiment wherein the Cascade complex comprises six fused cpCas7 subunit proteins (a "backbone"), wherein the C-terminus of the first cpCas7 subunit protein is connected with the N-terminus of the second cpCas7 subunit protein using a linker polypeptide, the C-terminus of the second cpCas7 subunit protein is connected with the N-terminus of a different protein sequence ("FP") (e.g., a cytidine deaminase) using a linker polypeptide and the C-terminus of this protein coding sequence is connected with the N-terminus of the third cpCas7 using a linker polypeptide. One advantage of such a fused backbone of cpCas7 subunit proteins is that an additional protein sequence can be introduced at a specific location along the backbone to provide access of the additional protein sequence to different locations along the length of the nucleic acid target sequence to which the guide directs binding of the Cascade complex.

Figure 8B:
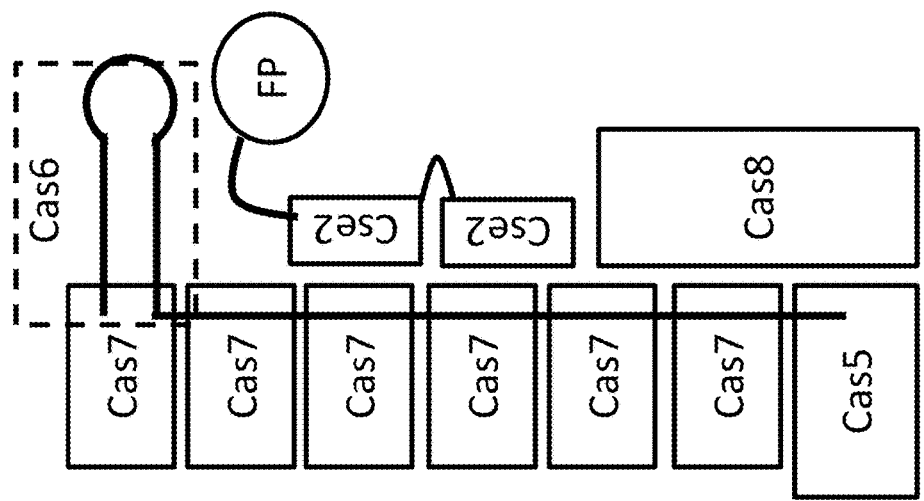
Figure 8A:
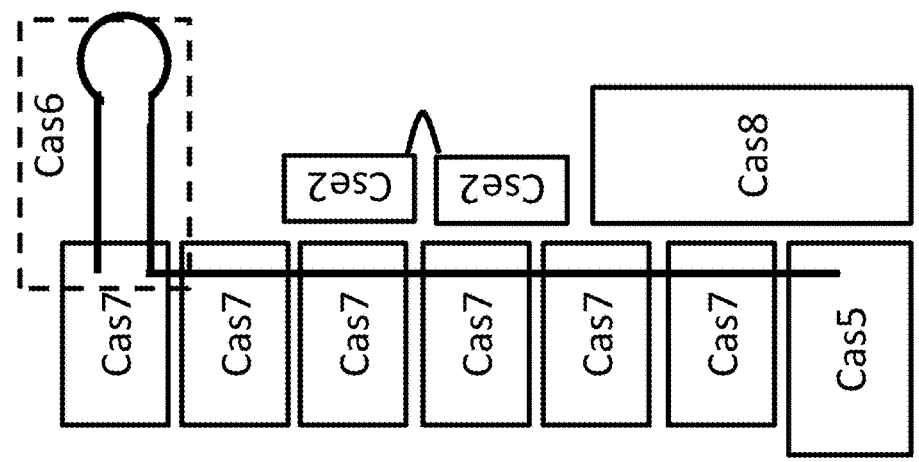

FIG. 8A and FIG. 8B illustrate further embodiments of modified Type I CRISPR-Cas effector complexes comprising fusion proteins. FIG. 8A shows a Cascade complex comprising a Cse2-Cse2 fusion protein. In silico design, cloning, expression, purification, and electrophoretic mobility shift assays are described in Example 11B and Example 11C Cascade complexes comprising Cse2-Cse2 fusion proteins. FIG. 8B shows a Cascade complex comprising a Cse2-Cse2 fusion protein connected with an additional protein sequence ("FP"). Example 11D describes in silico design, cloning, expression, and purification of a Cse2-Cse2 protein fused to a cytidine deaminase.

In some embodiments, one or more nuclear localization signals can be added at the engineered N-terminus or C-terminus of a Cascade protein subunit (e.g., a Cas8-FokI fusion protein, a cpCas7 protein, or a Cse2-Cse2 fusion protein).

In some embodiments of fusion polypeptides, linker polypeptides connect two or more protein coding sequences. The length of exemplary linker polypeptides are described in the Examples. Typically, linker lengths include, but are not limited to, between about 10 amino acids to about 40 amino acids, between about 15 amino acids and about 30 amino acids, and between about 17 amino acids and about 20 amino acids. The amino acid composition of linker polypeptides typically comprises amino acids that are polar, small, and/or charged (e.g., Gly, Ala, Leu, Val, Gln, Ser, Thr, Pro, Glu, Asp, Lys, Arg, His, Asn, Cys, Tyr). Following the guidance of the present Specification, the linker polypeptide is designed to provide appropriate spacing and positioning of the functional domain and the Cascade protein within the fusion protein (Chichili, C., et al., Protein Science 22(2):

153-167 (2013); Chen, X., et al., 65(10):1357-1369 (2013); George, R., et al., Protein Engineering, Design and Selection 15:(11):871-879 (2002)). Additional examples of linker polypeptides useful in the practice of the present invention are linker polypeptides identified that connect coding sequences of Cascade proteins to each other in organisms comprising Cascade systems (e.g., the linker polypeptide that connects Cas8 to Cas3 in *Streptomyces griseus* as described by Westra, E. R., et al., Mol Cell. 46(5): 595-605 (2012)).

Fusion protein coding DNA sequences can be codon optimized for expression in a selected organism such as bacteria, archae, plants, fungi, or mammalian cells. Codon-optimizing programs are widely available. such as on the Integrated DNA Technologies website (www.idtdna.com/CodonOpt), or through Genscript® services (Genscript, Piscataway, N.J.). To facilitate cloning into the recipient expression vector, additional sequences overlapping with the vector compatible for SLIC cloning (Li, M., et al., Methods Mol. Biol. 852:51-59 (2012)) can be appended at the 5' and 3' ends of the DNA sequence.

In other embodiments, Cascade subunit proteins can be fused to transcription activation and/or repression domains. In some embodiments, a fusion protein can comprise activator domains (e.g., heat shock transcription factors, NFKB activators, VP16, and VP64 (Eguchi, A. et. al., PNAS 113(51):E8257-E8266 (2016); Perez-Pinera, P. et. al., Nature Methods 10(10):973-6 (2013); Gilbert, L. A., et. al. Cell 159(3):647-61 (2014)) or repressor domains (e.g., a KRAB domain). In some embodiments, linker nucleic acid sequences are used to join the two or more coding sequences for proteins, protein domains, or protein fragments.

Figure 9:
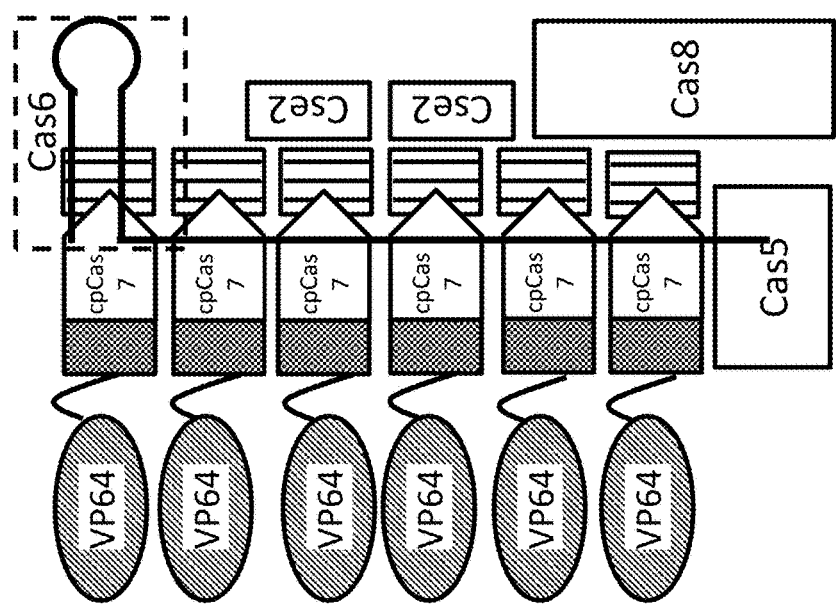

Cascade complexes comprising Type I CRISPR-Cas subunit proteins fused to transcription activators can be used to activate the expression of the gene. The target locus can contain a transcriptional start site (TSS) that typically harbors one or more binding site for the transcriptional activation machinery (factors) of a cell. FIG. 9 illustrates a Cascade complex comprising six fusion proteins comprising a cpCas7 connected via a linker polypeptide to the transcriptional activator VP64. Such modification of a Cascade complex converts the complex into a flexible tool for transcriptional activation of a gene (CASCADEa), wherein targeting a selected gene is achieved by selection of a guide sequence that directs binding of the Cascade complex to one or more regulatory elements (e.g., a TSS) of the selected gene. Example 12 describes the design of a *E. coli* Type I-E cp-Cas7 protein fused to a VP64 activation domain to confer transcriptional activation activity to the Cascade complex.

In addition, Cascade complexes comprising Type I CRISPR-Cas subunit proteins fused to transcription repressors can be used to repress the expression of the gene. The target locus can comprise transcriptional regulatory elements. In one embodiment, a Cascade subunit protein can be connected to a KRAB domain via a linker polypeptide. A Cascade complex comprising the Cascade subunit protein/KRAB domain fusion can convert the complex into a flexible tool for transcriptional repression of a gene (CASCADEi), wherein targeting a selected gene is achieved by selection of a guide sequence that directs binding of the Cascade complex to one or more regulatory elements of the selected gene.

In additional embodiments, Cascade subunit proteins can be fused to affinity tags.

Figure 10:
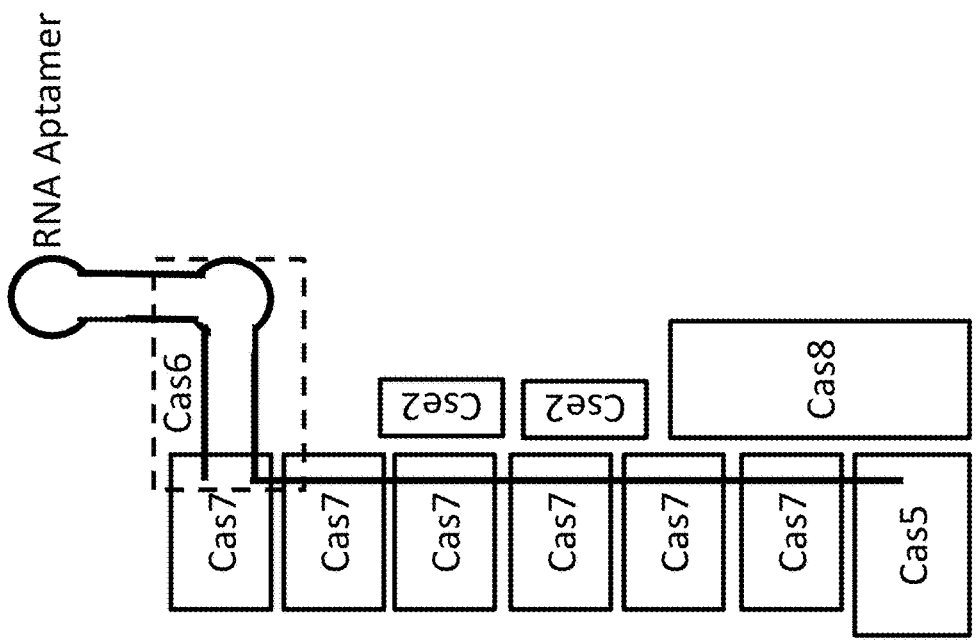

In other embodiments of the present invention, Type I CRISPR-Cas guide polynucleotides can be modified by insertion of a selected polynucleotide element or modification of a nucleotides at selected positions within the guide polynucleotides (e.g., substitution of a DNA moiety for a RNA moiety). Such embodiments include, but are not limited to, Type I CRISPR-Cas guide polynucleotides 5', 3' or internally fused to one or more nucleotide effector domain (e.g., an MS2 or MS2-P65-HSF1 binding RNA or Aptamer that recruits transcription factors). FIG. 10 illustrates a Type I CRISPR guide polynucleotide comprising an RNA aptamer introduced into the 3' hairpin of the guide.

Figure 11B:
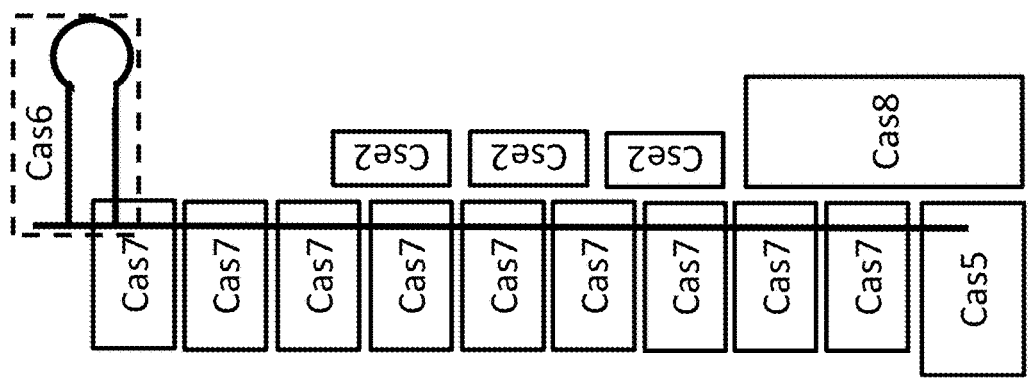
Figure 11A:
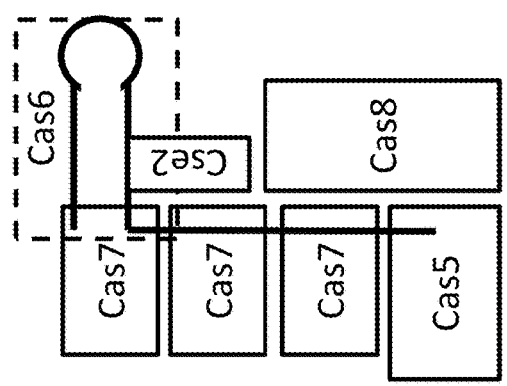

The length of Type I CRISPR-Cas guides can also be modified, typically by lengthening or shortening the Cas7 subunit protein and Cse2 subunit protein binding region. FIG. 11A illustrates a Cascade complex with three Cas7 subunits, one Cse2 subunit and a shortened crRNA. FIG. 11B illustrates a Cascade complex with nine Cas7 subunits, three Cse2 subunit and a lengthened crRNA.

Example 16 describes the generation and testing of modifications of Type I CRISPR-Cas guide crRNAs and the suitability of the modified guides for use in constructing engineered Type I CRISPR-Cas effector complexes.

In a third aspect, the present invention relates to nucleic acid sequences encoding one or more engineered Cascade components, as well as expression cassettes, vectors, and recombinant cells comprising nucleic acid sequences encoding one or more engineered Cascade components. Some embodiments of the third aspect of the invention include one or more polypeptide encoding all the components of a selected Cascade system (e.g., Cse2, Cas5, Cas6, Cas7, and Cas8 proteins, and one or more cognate guides), wherein the components are capable of forming an effector complex. Typically, when more than one cognate guide is expressed, the guides have different spacer sequences to direct binding to different nucleic acid target sequences. Such embodiments include, but are not limited to, expression cassettes, vectors, and recombinant cells.

In one embodiment, the present invention relates to one or more expression cassettes comprising one or more nucleic acid sequences encoding one or more engineered Cascade components. Expression cassettes typically comprise a regulatory sequence involved in one or more of the following: regulation of transcription, post-transcriptional regulation, or regulation of translation. Expression cassettes can be introduced into a wide variety of organisms including, but not limited to, bacterial cells, yeast cells, plant cells, and mammalian cells (including human cells). Expression cassettes typically comprise functional regulatory sequences corresponding to the organism(s) into which they are being introduced.

A further embodiment of the present invention relates to vectors, including expression vectors, comprising one or more nucleic acid sequences encoding one or more one or more engineered Cascade components. Vectors can also include sequences encoding selectable or screenable markers. Furthermore, nuclear targeting sequences can also be added, for example, to Cascade subunit proteins. Vectors can also include polynucleotides encoding protein tags (e.g., poly-His tags, hemagglutinin tags, fluorescent protein tags, and bioluminescent tags). The coding sequences for such protein tags can be fused to, for example, one or more nucleic acid sequences encoding a Cascade subunit protein.

General methods for construction of expression vectors are known in the art. Expression vectors for host cells are commercially available. There are several commercial software products designed to facilitate selection of appropriate vectors and construction thereof, such as insect cell vectors for insect cell transformation and gene expression in insect cells, bacterial plasmids for bacterial transformation and gene expression in bacterial cells, yeast plasmids for cell transformation and gene expression in yeast and other fungi, mammalian vectors for mammalian cell transformation and gene expression in mammalian cells or mammals, and viral vectors (including lentivirus, retrovirus, adenovirus, herpes simplex virus I or II, parvovirus, reticuloendotheliosis virus, and adeno-associated virus (AAV) vectors) for cell transformation and gene expression and methods to easily allow cloning of such polynucleotides. Illustrative plant transformation vectors include those derived from a Ti plasmid of *Agrobacterium tumefaciens* (Lee, L. Y., et al., Plant Physiology 146(2):325-332 (2008)). Also useful and known in the art are *Agrobacterium rhizogenes* plasmids. For example, SNAPGENE™ (GSL Biotech LLC, Chicago, Ill.; snapgene.com/resources/plasmid_files/your_time_is_valuable/) provides an extensive list of vectors, individual vector sequences, and vector maps, as well as commercial sources for many of the vectors.

In order to express and purify recombinant Cascade in a bacterial expression system, vectors can be designed that encode Cascade subunit proteins, as well as a minimal CRISPR arrays comprising guide sequences of interest. Accordingly, one aspect of the present invention includes such expression systems. In one embodiment, the Cascade complex is expressed off of three distinct plasmid vectors, which collectively encode the following components: a Cas8 protein; Cse2, Cas7, Cas5, and Cas6 proteins; and a CRISPR crRNA. In some embodiments, the expression plasmid encoding Cas8 comprises the natural, genomic DNA gene sequence and, in other embodiments, the expression plasmid can encode Cas8 that is codon optimized for expression in a chosen cell type. Similarly, the expression plasmid encoding Cse2, Cas7, Cas5, and Cas6 can contain the natural, genomic DNA gene sequences or can contain gene sequences that have been codon optimized for expression in a chosen cell type. In some embodiments, the entire Cascade subunit protein coding operon can be placed downstream of a single transcriptional promoter, such that the different proteins are all translated from a single polycistronic transcript. In additional embodiments, the gene encoding the Cascade subunit proteins can be separated from each other, with intervening transcriptional terminators and promoters.

The expression plasmid encoding the crRNA may contain as few as two repeats flanking a single spacer sequence, downstream of an appropriate transcriptional promoter, or may contain many repeats flanking multiple spacer sequences, of either the same exact guide sequence or multiple distinct guide sequences. Coordinated expression of the CRISPR and the Cascade subunits, in particular the Cas6 subunit, lead to processing of long precursor crRNAs into the mature length crRNA, each one of which comprises fragments of a single repeat on the 5' and 3' ends of the crRNA, and a single spacer sequence in the middle.

An alternative strategy to express the complete Cascade complex in *E. coli* uses two plasmids: one plasmid that encodes the entire Cas8-Cse2-Cas7-Cas5-Cas6 operon on a single expression plasmid and one encoding the CRISPR crRNA. In this case, the 5' end of the Cse2 gene, which normally overlaps with the 3' end of the Cas8 gene, is separated spatially from the 3' end of the Cas8 gene, in order to append a polynucleotide sequence encoding an affinity tag and/or protease recognition sequence.

Example 2 describes two types of bacterial expression plasmid systems for the Cascade proteins: the first type comprises two plasmids, a first plasmid encoding the Cas8 protein and a second encoding the 4 subunit proteins of the CasBCDE complex (cse2-cas7-cas5-cas6 operon); and the second type comprises an expression plasmid encoding all 5 subunit proteins of the Cascade complex (cas8-cse2-cas7-cas5-cas6 operon). Cognate CRISPR arrays are also described.

In order to facilitate purification of Cascade complexes, an affinity tag can be appended onto the Cse2 subunit, such as an N-terminal Strep-II tag or a hexahistidine (His6) tag. Furthermore, an amino acid sequence recognized by a protease, such as TEV protease or the HRV3C protease can be inserted between the affinity tag and the native N-terminus of the Cse2 subunit, such that biochemical cleavage of the sequence with the protease after initial purification liberates the affinity tag from the final recombinant Cascade complex. The affinity tag may also be placed on other subunits, or left on the Cse2 subunit and combined with additional affinity tags on other subunits. Examples of Cascade subunit proteins comprising affinity tags are set forth in Example 1, Example 2, and Example 3.

For Type I-E Cascade systems, a strain of *E. coli* can be transformed with plasmids encoding the CRISPR crRNA as well as the Cse2-Cas7-Cas5-Cas6 genes, protein expression induced, and a Cascade complex that is lacking the Cas8 subunit can be produced. This Cascade complex typically is referred to as a Cas8-minus Cascade complex, or alternatively as a CasBCDE complex (Jore, M., et al., Nat. Struct. Mol. Biol. 18(5):529-536 (2011)). This purified complex can be biochemically combined with separately purified Cas8 to reconstitute full Cascade (Sashital, D. G., et al., Mol. Cell 46(5):606-615 (2012)).

Table 4 presents exemplary sequences of bacterial expression plasmids encoding the minimal CRISPR array, Cas8, Cse2-Cas7-Cas5-Cas6 constructs, and Cas8-Cse2-Cas7-Cas5-Cas6 constructs, containing different tags and designs. Plasmids that encode Cascade complexes and Cascade complexes from homologous Type I systems can be designed similarly as the exemplary expression plasmid sequences for the Type I-E found in *E. coli* K-12 MG1655 following the guidance of the present Specification. Table 4 additionally contains sequences of expression plasmids expressing Cas8-Cse2-Cas7-Cas5-Cas6 as well as FokI fusions to either the Cas8 gene or the Cas6 gene, for the production of nuclease-Cascade fusions for gene editing experiments.

TABLE 4

Vectors for Production of Cascade Effector Complexes

| SED IDNO: | Description | Effector complex species of origin | Type of sequence |
|---|---|---|---|
| SEQ ID NO: 352 | minimal CRISPR array | I-E *Escherichia coli* K-12 MG1655 | Spacer sequence targets J3 |
| SEQ ID NO: 353 | minimal CRISPR array | I-E *Escherichia coli* K-12 MG1655 | Spacer sequence targets CCR5.1 |
| SEQ ID NO: 354 | minimal CRISPR array (J3/L3) | I-E *Escherichia coli* K-12 MG1655 | Dual-guide spacer sequence targets J3 and L3 |

TABLE 4-continued

Vectors for Production of Cascade Effector Complexes

| SED IDNO: | Description | Effector complex species of origin | Type of sequence |
|---|---|---|---|
| SEQ ID NO: 355 | minimal CRISPR array (Hsa07) | I-E *Escherichia coli* K-12 MG1655 | Dual-guide spacer sequence targets Hsa07 |
| SEQ ID NO: 356 | His6-MBP-TEV-Cas8 | I-E *Escherichia coli* K-12 MG1655 | Derived from genomic DNA, with appended tags |
| SEQ ID NO: 357 | StrepII-HRV3C-Cse2_Cas7_Cas5_Cas6 | I-E *Escherichia coli* K-12 MG1655 | Derived from genomic DNA, with appended tags |
| SEQ ID NO: 358 | Cas8_His6-HRV3C-Cse2_Cas7_Cas5_Cas6 | I-E *Escherichia coli* K-12 MG1655 | Derived from genomic DNA, with appended tags |
| SEQ ID NO: 359 | FokI-30aa-Cas8 His6-HRV3C-Cse2_Cas7_Cas5_Cas6 | I-E *Escherichia coli* K-12 MG1655 | Derived from genomic DNA, with appended tags |
| SEQ ID NO: 360 | FokI-30aa-Cas8_His6-HRV3C-Cse2_Cas7_Cas5_NLS-Cas6 | I-E *Escherichia coli* K-12 MG1655 | Derived from genomic DNA, with appended tags |
| SEQ ID NO: 361 | FokI-30aa-Cas8 His6-HRV3C-Cse2_Cas7-NLS_Cas5_Cas6 | I-E *Escherichia coli* K-12 MG1655 | Derived from genomic DNA, with appended tags |
| SEQ ID NO: 362 | Cas8_His6-HRV3C-Cse2_Cas7_Cas5_Cas6-20aa-FokI | I-E *Escherichia coli* K-12 MG1655 | Derived from genomic DNA, with appended tags |

Table 5 contains the sequences of single polypromoter bacterial expression plasmids encoding all 5 subunit proteins together with the crRNA from a single bacterial expression plasmid. In this design, each gene is separated from the other genes it flanks upstream and downstream with a transcriptional promoter and terminator. Additional sequences can be introduced that encode an affinity tag and/or protease recognition tag, as well as a fusion to a nuclease protein, in order to generate a Cascade-nuclease fusion for gene editing.

TABLE 5

Vectors for Production of Cascade Effector Complexes

| SED ID NO: | Description | Effector complex species of origin | Type of sequence |
|---|---|---|---|
| SEQ ID NO: 363 | Polypromoter, Cas5_Cas3_Cse2_Cas7_Cas6_Cas8_CRISPR(J3) | I-E *Escherichia coli* K-12 MG1655 | Derived from genomic DNA, with appended tags |
| SEQ ID NO: 364 | Polypromoter, Cas5_Cas3_Cse2_Cas7_CRISPR(J3)_Cas6_Cas8 | I-E *Escherichia coli* K-12 MG1655 | Derived from genomic DNA, with appended tags |
| SEQ ID NO: 365 | Polypromoter(EcoCO), CRISPR(J3/L3)_Cse2_Cas7_Cas5_Cas8_Cas6 | I-E *Escherichia coli* K-12 MG1655 | *E. coli* codon-optimized DNA gene sequences |
| SEQ ID NO: 366 | Polypromoter(EcoCO), CRISPR(J3/L3)_Cse2_Cas7_Cas5_Cas8_FokI-30aa-Cas6 | I-E *Escherichia coli* K-12 MG1655 | *E. coli* codon-optimized DNA gene sequences |
| SEQ ID NO: 367 | Polypromoter(EcoCO), CRISPR(J3/L3)_Cse2_Cas7_Cas5_Cas6 FokI-30aa-Cas8 | I-E *Escherichia coli* K-12 MG1655 | *E. coli* codon-optimized DNA gene sequences |

Additional bacterial expression plasmids can be designed encoding homologous Cascade complexes from other Type I subtypes and other bacterial or archaeal organisms based on the design criteria herein. Such expression plasmids can be designed with genomic DNA sequences for the Cascade genes, or they can be designed with gene sequences that have been codon optimized for expression in *E. coli* or other bacterial strains.

In order to express Cascade or effectors fusions to Cascade in mammalian cells, such as human cells, eukaryotic expression plasmid vectors were designed to enable expression of the relevant proteins and RNA components by eukaryotic transcription and translation machinery. In one embodiment, Cascade can be generated in mammalian cells by encoding each of the protein components on a separate expression vector driven by a eukaryotic promoter (e.g., a cytomegalovirus (CMV) promoter), and encoding the crRNA on a separate expression vector driving by a RNA Polymerase III promoter (e.g., the human U6 promoter). The CRISPR RNA can be encoded with a minimal CRISPR array containing at least two repeats flanking one or more spacer sequences that function as the guide portion of the mature crRNA. The construct generating CRISPR RNA can be designed with additional sequences flanking the outermost repeats in the minimal array. Processing of the precursor CRISPR RNA is enabled by the RNA processing subunit of the Cascade complex (Cas6 subunit protein), which can be expressed from a separate plasmid.

Table 6 contains the sequences of individual eukaryotic expression plasmids for each protein of the *E. coli* Type I-E Cascade complex. Cas8 subunit can be fused to additional effector nuclease domains, such as the FokI nuclease (Example 1 and Example 3). Table 6 also contains the sequences of expression plasmids for the crRNA component of Cascade, encoding two separate dual-guide crRNAs, whereby three repeat sequences flank two spacer spacers. Each of the protein-coding genes can be appended to polynucleotide sequences that append nuclear localization signals (NLS), affinity tags, and linker sequences connecting those tags. Other fusions to any of the Cascade subunit proteins can be encoded by additional polynucleotide sequences that typically are appended to either the 5' or 3' coding sequence, including additional polynucleotide sequences that encode amino acid linkers connecting to the Cascade subunit protein to additional polypeptide sequences of interest. Examples of candidate fusions proteins are described herein.

TABLE 6

Vectors for Production of Cascade Effector Complexes

| SED ID NO: | Description | Effector complex species of origin | Type of sequence |
|---|---|---|---|
| SEQ ID NO: 368 | Cas8, HsCO | I-E_Escherichia coli K-12 MG1655 | Homo sapiens codon-optimized DNA gene sequence |
| SEQ ID NO: 369 | NLS-Cas8, HsCO | I-E_Escherichia coli K-12 MG1655 | Homo sapiens codon-optimized DNA gene sequence |
| SEQ ID NO: 370 | NLS-HA-FokI-30aa-Cas8, HsCO | I-E_Escherichia coli K-12 MG1655 | Homo sapiens codon-optimized DNA gene sequence |
| SEQ ID NO: 371 | NLS-Cse2, HsCO | I-E_Escherichia coli K-12 MG1655 | Homo sapiens codon-optimized DNA gene sequence |
| SEQ ID NO: 372 | NLS-Cas7, HsCO | I-E_Escherichia coli K-12 MG1655 | Homo sapiens codon-optimized DNA gene sequence |
| SEQ ID NO: 373 | Cas5, HsCO | I-E_Escherichia coli K-12 MG1655 | Homo sapiens codon-optimized DNA gene sequence |
| SEQ ID NO: 374 | NLS-Cas5, HsCO | I-E_Escherichia coli K-12 MG1655 | Homo sapiens codon-optimized DNA gene sequence |
| SEQ ID NO: 375 | Cas6, HsCO | I-E_Escherichia coli K-12 MG1655 | Homo sapiens codon-optimized DNA gene sequence |
| SEQ ID NO: 376 | NLS-Cas6, HsCO | I-E_Escherichia coli K-12 MG1655 | Homo sapiens codon-optimized DNA gene sequence |
| SEQ ID NO: 377 | NLS-V5-FokI-30aa-Cas8, HsCO | I-E_Escherichia coli K-12 MG1655 | Homo sapiens codon-optimized DNA gene sequence |
| SEQ ID NO: 378 | Cas3-NLS, HsCO | I-E_Escherichia coli K-12 MG1655 | Homo sapiens codon-optimized DNA gene sequence |
| SEQ ID NO: 379 | CRTSPR(Hsa07) | I-E_Escherichia coli K-12 MG1655 | Homo sapiens codon-optimized DNA gene sequence |

In order to express components of the Cascade complex on fewer expression vectors, polycistronic expression vectors can be constructed, whereby a single promoter (e.g., CMV promoter) drives expression of multiple coding sequence simultaneously that are separated by a *Thosea asigna* virus 2A sequence. 2A viral peptide sequences induce ribosomal skipping, thus enabling multiple protein-coding genes to be concatenated within a single polycistronic construct for expression in eukaryotic cells. Thus, polycistronic vectors can be designed that encode 4 or 5 subunits of the Cascade complex on a single transcript driven by a single promoter. Table 7 contains the sequences of eukaryotic polycistronic expression plasmids that can be combined with a CRISPR RNA expression plasmid to produce functional Cascade in mammalian cells.

TABLE 7

Vectors for Production of Cascade Effector Complexes

| SED ID NO: | Description | Effector complex species of origin | Type of sequence |
|---|---|---|---|
| SEQ ID NO: 380 | Polycistronic(HsCO), NLS-Cas7_NLS-Csc2_NLS-Cas5_NLS-Cas6 | I-E_Escherichia coli K-12 MG1655 | Homo sapiens codon-optimized DNA gene sequence |
| SEQ ID NO: 381 | Polycistronic(HsCO), NLS-Cas7_NLS-Cse2_NLS-Cas5_NLS-Cas6_NLS-Cas8 | I-E_Escherichia coli K-12 MG1655 | Homo sapiens codon-optimized DNA gene sequence |
| SEQ ID NO: 382 | Polycistronic(HsCO), NLS-Cas7_NLS-Cse2_NLS-Cas5_NLS-Cas6_NLS-FokI-30aa-Cas8 | I-E_Escherichia coli K-12 MG1655 | Homo sapiens codon-optimized DNA gene sequence |
| SEQ ID NO: 383 | Polycistronic(HsCO), NLS-Cas7_NLS-Cse2_NLS-Cas5_NLS-Cas6_NLS-FokI-30aa-Cas8, no epitope tags | I-E_Escherichia coli K-12 MG1655 | Homo sapiens codon-optimized DNA gene sequence |
| SEQ ID NO: 384 | Polycistronic(HsCO), NLS-Cas7_NLS-Cse2_NLS-Cas5_NLS-FokI-30aa-Cas6_NLS-Cas8, no epitope tags | I-E_Escherichia coli K-12 MG1655 | Homo sapiens codon-optimized DNA gene sequence |

In some embodiments, the CRISPR RNA is encoded within the 3' untranslated region (UTR) of a protein-coding gene, whose expression is driven by a RNA Polymerase II promoter (e.g., CMV promoter) to produce a transcript. In such embodiments, the minimal CRISPR array is designed to exist downstream of a protein coding gene such as Cas6, Cas7, or a reporter gene (e.g., an enhanced green fluorescent protein, eGFP), and is separated from the protein coding sequence by a MALAT1 triplex sequence that has previously been shown to confer stability to the upstream transcript. The minimal CRISPR array is processed by the RNA processing subunit of Cascade (typically expressed using a different plasmid), an endonuclease that cleaves the minimal CRISPR array, and a break is introduced into the transcript, and the triplex sequence protects the 3' end of the upstream protein-coding gene from premature exonucleolytic degradation. Table 8 contains sequences of three polynucleotide sequences, whereby the CRISPR array is cloned downstream of either Cas6, Cas7, or eGFP, and expression of the entire fusion sequence is driven by a CMV promoter.

TABLE 8

Vectors for Production of Minimal CRISPR Arrays

| SED ID NO: | Description | Effector complex species of origin | Type of sequence |
|---|---|---|---|
| SEQ ID NO: 385 | eGFP_MALAT1-triplex_CRISPR (IIsa07) | I-E_Escherichia coli K-12 MG1655 | Homo sapiens codon-optimized DNA gene sequence |
| SEQ ID NO: 386 | NLS-Cas7_MALAT1-triplex_CRISPR (Hsa07) | I-E_Escherichia coli K-12 MG1655 | Homo sapiens codon-optimized DNA gene sequence |
| SEQ ID NO: 387 | NLS-Cas6_MALAT1-triplex_CRISPR (Hsa07) | I-E_Escherichia coli K-12 MG1655 | Homo sapiens codon-optimized DNA gene sequence |

In some embodiments, the CRISPR RNA array is encoded on the same vector as the polycistronic construct driving expression of the 5 Cascade subunits; the combination of these two elements generates an all-in-one vector that produces all functional subunits (both protein and RNA) of the Cascade complex, together with any nuclease or effector domains fused to one of the Cascade subunits. Table 9 contains two representative sequences of these all-in-one polynucleotide sequences that encode all the respective components to produce functional FokI-Cascade RNPs in mammalian cells.

TABLE 9

Vectors for Production of Cascade Effector Complexes

| SED ID NO: | Description | Effector complex species of origin | Type of sequence |
|---|---|---|---|
| SEQ ID NO: 388 | hU6_CRISPR(Hsa07)_F, CMV-/NLS-Cas7_NLS-Cse2_NLS-Cas5_NLS-Cas6_NLS-FokI-30aa-Cas8 | I-E _Escherichia coli_ K-12 MG1655 | _Homo sapiens_ codon-optimized DNA gene sequence |
| SEQ ID NO: 389 | hU6_CRISPR(Hsa07)_R, CMV_NLS-Cas7_NLS-Cse2_NLS-Cas5_NLS-Cas6_NLS-FokI-30aa-Cas8 | I-E _Escherichia coli_ K-12 MG1655 | _Homo sapiens_ codon-optimized DNA gene sequence |

Example 3 describes expression systems using separate plasmids expressing each Cascade subunit protein and minimal CRISPR array, expression systems wherein multiple Cascade subunit protein coding sequences are expressed from a single promoter, and an expression system wherein a single plasmid Cascade expression system was constructed to express the entire Cas8-Cse2-Cas7-Cas5-Cas6 operon and a minimal CRISPR array for use in mammalian cells.

One of ordinary skill in the art following the guidance of the present Specification can design additional mammalian expression vectors encoding other Cascade complexes analogously to the examples provided the _E. coli_ Type I-E Cascade complex.

In a fourth aspect, the present invention relates to production of engineered Type I CRISPR-Cas effector complexes by introduction of plasmids encoding one or more components of the engineered Type I CRISPR-Cas effector complexes into host cells. Transformed host cells (or recombinant cells) or the progeny of cells that have been transformed or transfected using recombinant DNA techniques can comprise one or more nucleic acid sequences encoding one or more component of an engineered Type I CRISPR-Cas effector complex. Methods of introducing polynucleotides (e.g., an expression vector) into host cells are known in the art and are typically selected based on the kind of host cell. Such methods include, for example, viral or bacteriophage infection, transfection, conjugation, electroporation, calcium phosphate precipitation, polyethyleneimine-mediated transfection, DEAE-dextran mediated transfection, protoplast fusion, lipofection, liposome-mediated transfection, particle gun technology, microprojectile bombardment, direct microinjection, and nanoparticle-mediated delivery. In one embodiment of the present invention, polynucleotides encoding components of engineered Type I CRISPR-Cas effector complexes are introduced into bacterial cells (e.g., _E. coli_).

Example 4 describes a method for introduction and expression of Cas8 protein coding sequences, as well as coding sequences for components of engineered Type I CRISPR-Cas effector complexes for bacterial production of such complexes using _E. coli_ expression systems.

A variety of exemplary host cells disclosed herein can be used to produce recombinant cells using an engineered Cascade effector complex. Such host cells include, but are not limited to, a plant cell, a yeast cell, a bacterial cell, an insect cell, an algal cell, and a mammalian cell.

For ease of discussion, "transfection" is used below to refer to any method of introducing polynucleotides into a host cell.

In some embodiments, a host cell is transiently or non-transiently transfected with nucleic acid sequences encoding one or more component of a Type I CRISPR-Cas effector complex. In some embodiments, a cell is transfected as it naturally occurs in a subject. In some embodiments, a cell that is transfected is first removed from a subject, e.g., a primary cell or progenitor cell. In some embodiments, the primary cell or progenitor cell is cultured and/or is returned after ex vivo transfection to the same subject or to a different subject.

Example 9 illustrates the design and delivery of _E. coli_ Type I-E Cascade complexes comprising FolkI fusion proteins to facilitate genome editing in human cells. The Example describes the delivery of plasmid vectors expressing Cascade complex components into eukaryotic cells.

In a fifth aspect, the present invention relates to the purification of engineered Type I CRISPR-Cas effector complexes from cells and uses of such complexes. Engineered Type I CRISPR-Cas effector complexes are produced in a host cell. The engineered Type I CRISPR-Cas effector complexes (in this case Cascade ribonucleoprotein (RNP) complexes) are purified from cell lysates.

Example 5 describes purification of _E. coli_ Type I-E Cascade RNP complexes produced by overexpression in bacteria as described in Example 4. The method uses immobilized metal affinity chromatography followed by size exclusion chromatography. The Example also describes methods that can be used to assess the quality of purified Cascade RNP products. Examples are presented illustrating the purification of Cas8, Cas7, Cas6, Cas5, and Cse2 Cascade RNP complexes, Cascade complexes comprising Cas7, Cas6, Cas5, and Cse2 proteins, and FokI-Cas8 fusion proteins.

The purified, engineered Type I CRISPR-Cas effector complexes can also be used directly in biochemical assays (e.g., binding and/or cleavage assays). Example 6 describes production of dsDNA target sequences for use in in vitro DNA binding or cleavage assays. The Example describes three methods to produce target sequences, including annealing of synthetic ssDNA oligonucleotides, PCR amplification of selected nucleic acid target sequences from genomic DNA, as well as cloning of nucleic acid target sequences into bacterial plasmids. The dsDNA target sequences were used in Cascade binding or cleavage assays.

The site-specific binding of and/or cutting by one or more engineered Type I CRISPR-Cas effector complexes can be confirmed, if necessary, using an electrophoretic mobility shift assay (see, e.g., Garner, M., et al., Nucleic Acids Research 9(13):3047-3060 (1981); Fried, M., et al., Nucleic Acids Research 9(23):6505-6525 (1981); Fried, M., Electrophoresis 10:366-376 (1989); Gagnon, K., et al., Methods Molecular Biology 703:275-2791 (2011); Filleben, C., et al., J. Vis. Exp. (94), e52230, doi:10.3791/52230 (2014)), or the biochemical cleavage assay described in Example 7.

The data presented in Example 7 demonstrate that engineered Type I CRISPR-Cas effector complexes can exhibited nearly quantitative DNA cleavage, as evidenced by conversion of a supercoiled, circular plasmid substrate into a cleaved, linear form.

In another embodiment, the complexes are introduced directly into a cell, as an alternative to expressing one or more nucleic acid sequences encoding one or more components of engineered Type I CRISPR-Cas effector complexes in a cell. The purified, engineered Type I CRISPR-Cas effector complexes can be directly introduced into cells. Methods to introduce the components into a cell include electroporation, lipofection, particle gun technology, and microprojectile bombardment.

Example 8 illustrates the design and delivery of *E. coli* Type I-E Cascade complexes comprising Cas subunit protein-FokI fusion proteins to human cells. The data in the Example demonstrate delivery of pre-assembled Cascade RNPs into target cells and effective genome editing in human cells.

In some embodiments, the engineered Type I CRISPR-Cas effector complexes described herein can be used to generate non-human transgenic organisms by site specifically introducing a selected polynucleotide sequence (e.g., a portion of a donor polynucleotide) at a DNA target locus in the genome to generate a modification of the genomic DNA. The transgenic organism can be an animal or a plant.

A transgenic animal is typically generated by introducing engineered Type I CRISPR-Cas effector complexes into a zygote cell. A basic technique, described with reference to making transgenic mice (see, e.g., Cho, A., et al., "Generation of Transgenic Mice," Current Protocols in Cell Biology, CHAPTER.Unit-19.11 (2009)) involves five basic steps: first, preparation of a system, as described herein, including a suitable donor polynucleotide; second, harvesting of donor zygotes; third, microinjection of the system into the mouse zygote; fourth, implantation of microinjected zygotes into pseudo-pregnant recipient mice; and fifth, performing genotyping and analysis of the modification of the genomic DNA established in founder mice. The founder mice will pass the genetic modification to any progeny. The founder mice are typically heterozygous for the transgene. Mating between these mice will produce mice that are homozygous for the transgene 25% of the time.

Methods for generating transgenic plants are also well known and can be applied using engineered 1 Type I CRISPR-Cas effector complexes. A generated transgenic plant, for example using *Agrobacterium*-mediated transformation, typically contains one transgene inserted into one chromosome. It is possible to produce a transgenic plant that is homozygous with respect to a transgene by sexually mating (i.e., selfing) an independent segregant transgenic plant containing a single transgene to itself. Typical zygosity assays include, but are not limited to, single nucleotide polymorphism assays and thermal amplification assays that distinguish between homozygotes and heterozygotes.

In a sixth aspect, the present invention relates to use of engineered Type I CRISPR-Cas effector complexes to create substrate channels. In some embodiments, fusion proteins comprising substrate channel elements and Cas7 subunit proteins are constructed. These Cas7 fusion proteins are then assembled into an engineered Type I CRISPR-Cas effector complex (e.g., comprising Cse2, Cas5, Cas6, Cas7-substrate channel element fusions, and Cas8). In some embodiments, the crRNA of the engineered Type I CRISPR-Cas effector complex can be extended to accommodate additional Cas7 subunits (Luo, M., et al., Nucleic Acids Research 44:7385-7394 (2016)). Different substrate elements can be fused to Cas7 and then mixed at the desired stoichiometry. When these various Cas7 subunits assemble into a complete Type I CRISPR-Cas effector complex, co-localization of substrate elements can improve the efficacy of substrate channeling.

In some embodiments, an RNA scaffold is constructed such that multiple Cas7-substrate channel element fusions can bind to it in the absence of other Type I CRISPR-Cas effector complex components.

Substrate channel elements can be fused to the N-terminus of Cas7 and/or the C-terminus of Cas7. In addition, circular permutations of Cas7 can be fused to substrate channel elements.

Figure 12A:
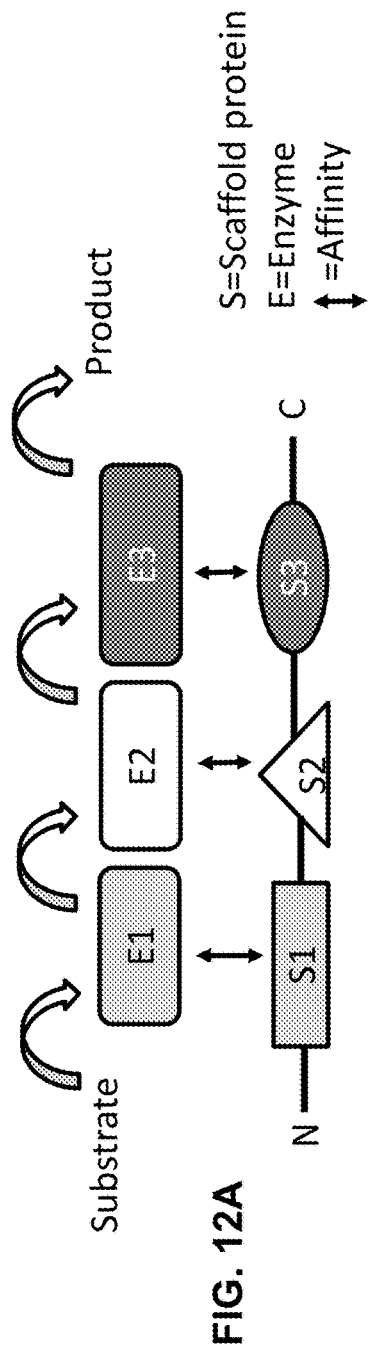
FIG. 12A and FIG. 12B illustrate examples of substrate channels.
Figure 12B:
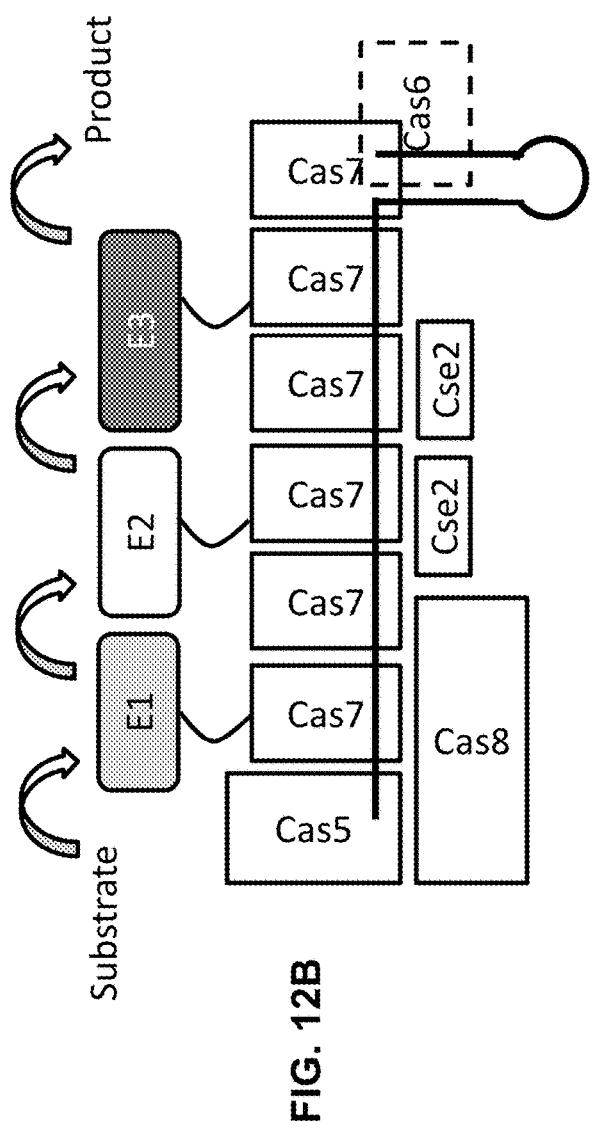

FIG. 12A and FIG. 12B presents illustrations of substrate channels consisting of three consecutive enzymes in a pathway. Substrate channels facilitate the passing of intermediary metabolic products directly to the active site of the consecutive enzyme in the metabolic pathway chain without release into the extra channel space. FIG. 12A illustrates a typical arrangement of an engineered substrate channel. Enzymes E1, E2, and E3 are linked covalently or non-covalently to a scaffold protein (S1, S2, S3) matrix. The substrate is then processed to the product without release to the extra channel space. FIG. 12B illustrates one embodiment of the present invention comprising a modified Type I CRISPR-Cas effector complex that carries Enzymes E1, E2, and E3 as fusion proteins to Cas7 subunit proteins, thus creating a substrate channel. cpCas7 proteins and backbones formed of cpCas7 proteins can also be useful in the practice of this aspect of the present invention.

In other embodiments, substrate channel elements can be fused to Cas6. The Cas6 subunit of Cascade complexes recognizes specific RNA hairpin structures. An RNA scaffold can be constructed that is composed of multiple Cas6 RNA hairpin structures concatenated together. Cas6 peptides from different Cascade complexes have different recognition sequences. Accordingly, RNA scaffolds can be constructed from multiple orthogonal Cas6 RNA hairpins. By fusing different substrate channel elements to orthogonal Cas6 peptides, substrate channel complexes can be assembled in specific stoichiometry.

Substrate channel elements can be fused to the N-terminus of Cas6 and/or the C-terminus of Cas6. In addition, circular permutations of Cas6 can be fused to substrate channel elements.

In some embodiments, a heterologous metabolic pathway of interest can be expressed in a model organism, such as *E. coli*. When genes are heterologously expressed, the genes can be codon optimized to express the genes more efficiently.

In one embodiment, the metabolic pathway of interest is the mevalonate pathway from *Saccharomyces cerevisiae*. Substrate channel elements of this pathway include, but are not limited to, acetoacetyl-CoA-thioase (AtoB), hydroxymethylglutaryl-CoA synthase (HMGS), and hydroxy-methylglutaryl-CoA reductase (HMGR).

In another embodiment, the metabolic pathway of interest is the glycerol synthesis pathway from *S. cerevisiae*. Substrate channel elements of this pathway include, but are not limited to, glycerol-3-phosphate dehydrogenase (GPD1) and glycerol-3-phosphate phosphatase (GPP2).

In yet another embodiment, the metabolic pathway of interest is the starch hydrolysis pathway from *Clostridium stercorarium*. Substrate channel elements of this pathway include, but are not limited to, CelY and CelZ.

In an additional embodiment, the metabolic pathway of interest is the glucose phosphotransferase pathway from *E. coli*. Substrate channel elements of this pathway include, but are not limited to, trehalose-6-phosphate synthetase (TPS) and trehalose-6-phosphate phosphatase (TPP).

In a seventh aspect, the present invention relates to site-directed recruitment of functional domains fused to Cascade subunit proteins by complexes comprising a Class 2 Type II Cas9 protein and a nucleic acid-targeting nucleic acid (NATNA; see e.g., U.S. Pat. No. 9,260,752, issued 16 Feb. 2016; U.S. Pat. No. 9,580,727, issued 28 Feb. 2017; U.S. Pat. No. 9,677,090, issued 13 Jun. 2017; U.S. Pat. No. 9,771,600, issued 26 Sep. 2017; U.S. Pat. No. 9,816,093, issued 14 Nov. 2017). Functional domains are disclosed herein and include, but are not limited to, protein domains having enzymatic function, capable of transcriptional activation, or capable of transcriptional repression. Example 13 describes a method of modifying a Class 2 Type II CRISPR sgRNA, crRNA, tracrRNA, or crRNA and tracrRNA sequences with a Class 1 Type I CRISPR repeat stem sequence, allowing for the recruitment of one or more Cascade subunit proteins to a Type II CRISPR Cas protein/guide RNA complex binding site.

Figure 13A:
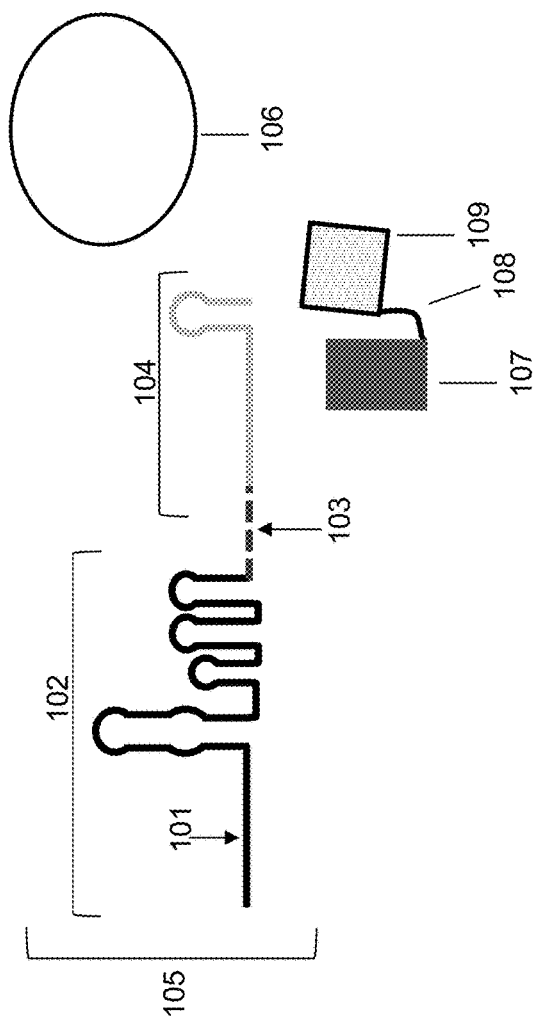
Figure 13B:
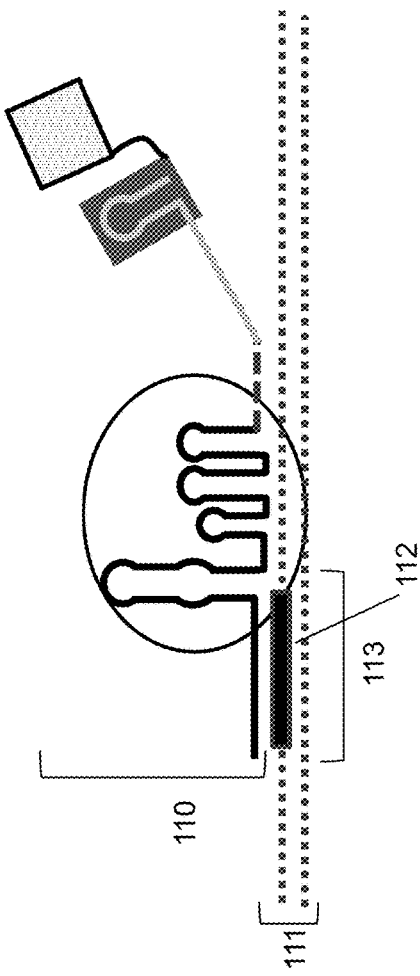

FIG. 13A, FIG. 13B, and FIG. 13C present a generalized illustration of the site-directed recruitment of a functional protein domain fused to a Cascade subunit protein by a dCas9:NATNA complex to a target site. A Class 2 Type II CRISPR NATNA (FIG. 13A, 102) comprising a spacer sequence (FIG. 13A, 101) is covalently linked through a linker nucleic acid sequence (FIG. 13A, 103) to a Class 1 Type I CRISPR repeat stem sequence (FIG. 13A, 104). The Type II CRISRP NATNA covalently linked to the Type I CRISPR repeat stem sequence (FIG. 13A, 105) is capable of binding to a Type II dCas9 (FIG. 13A, 106) and a Type I Cascade subunit protein (e.g., Cas6; FIG. 13A, 107) which is fused though a linker sequence (FIG. 13A, 108) to a functional protein domain (e.g., an enzymatic domain, a transcriptional activation or repression domain; FIG. 13A, 109) to form an RNP complex. This RNP complex (FIG. 13B, 110) is capable of targeting a double-stranded DNA (FIG. 13B, 111) comprising a target sequence (FIG. 13B, 112) complementary to the Type II CRISPR NATNA spacer sequence (FIG. 13A, 101). Target recognition by the RNP complex results in hybridization (FIG. 13B, 113) between the spacer sequence (FIG. 13A, 101) and the target sequence (FIG. 13B, 112). Localization of the Cascade subunit-functional domain fusion protein to the DNA allows for modification of the DNA by the functional protein domain or transcriptional regulation of an adjacent gene (FIG. 13C, 114).

In an eighth aspect, the present invention relates to compositions comprising engineered Type I CRISPR-Cas effector complexes, modified guide polynucleotides, and combinations thereof. In some embodiments, the engineered Type I CRISPR-Cas effector complex comprises an associated Cas3 fusion protein.

An embodiment of this aspect of the present invention relates to a composition comprising two engineered Type I CRISPR-Cas effector complexes each comprising a spacer and a fusion protein comprising a Cas subunit and an endonuclease (e.g., a FokI; see e.g., the Cascade complexes of FIG. 2A, FIG. 2B, and FIG. 2C), wherein at least two parameters are varied to modulate genome editing efficiency. Such parameters include:

the length of a linker polypeptide used to produce the fusion protein comprising a Cas subunit protein and the endonuclease (e.g., FokI); and the length of the interspacer distance between the nucleic acid target sequences to which the spacers are capable of binding.

Guidance is provided herein regarding the amino acid composition and sequence linker polypeptides.

One embodiment of this aspect of the present invention is a composition comprising:

a first engineered Type I CRISPR-Cas effector complex comprising, a first Cse2 subunit protein, a first Cas5 subunit protein, a first Cas6 subunit protein, and a first Cas7 subunit protein, a first fusion protein comprising a first Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FokI, and wherein the first linker polypeptide has a length of between 10 amino acids to 40 amino acids, and a first guide polynucleotide comprising a first spacer capable of binding a first nucleic acid target sequence; and a second engineered Type I CRISPR-Cas effector complex comprising, a second Cse2 subunit protein, a second Cas5 subunit protein, a second Cas6 subunit protein, and a second Cas7 subunit protein, a second fusion protein comprising a second Cas8 subunit protein and a second FokI, wherein the N-terminus of the second Cas8 subunit protein or the C-terminus of the second Cas8 protein is covalently connected by a second linker polypeptide to the C-terminus or N-terminus, respectively, of the second FokI, and wherein the second linker polypeptide has a length of between 10 amino acids to 40 amino acids, and a second guide polynucleotide comprising a second spacer capable of binding a second nucleic acid target sequence, wherein a protospacer adjacent motif (PAM) of the second nucleic acid target sequence and a PAM of the first nucleic acid target sequence have an interspacer distance between 20 bp 42 bp.

Examples of such a first engineered Type I CRISPR-Cas effector complex bound to a first nucleic acid target sequence and a second engineered Type I CRISPR-Cas effector complex bound to a second nucleic acid target sequence are illustrated in FIG. 2A, FIG. 2B, and FIG. 2C.

In some embodiments, the length of the first linker polypeptide and/or the second linker polypeptide is a length of between about 15 amino acids and about 30 amino acids, or between about 17 amino acids and about 20 amino acids. In one embodiment, the length of the first linker polypeptide and the second linker polypeptide are the same.

The first Cas8 subunit protein and the second Cas8 subunit protein can each comprise identical amino acid sequences of the Cas8 subunit protein.

Similarly, the first Cse2 subunit protein and the second Cse2 subunit protein can each comprise identical amino acid sequences of the Cse2 subunit protein, the first Cas5 subunit protein and the second Cas5 subunit protein can each comprise identical amino acid sequences of the Cas5 subunit protein, the first Cas6 subunit protein and the second Cas6 subunit protein can each comprise identical amino acid sequences of the Cas6 subunit protein, the first Cas7 subunit protein and the second Cas7 subunit protein can each comprise identical amino acid sequences of the Cas7 subunit protein, and combinations thereof.

Typically, the N-terminus of the first Cas8 subunit protein is covalently connected by the first linker polypeptide to the C-terminus of the first FokI, the C-terminus of the first Cas8 subunit protein is covalently connected by a first linker polypeptide to the N-terminus of the first FokI, the N-terminus of the second Cas8 subunit protein is covalently connected by the second linker polypeptide to the C-terminus of the second FokI, the C-terminus of the second Cas8 subunit protein is covalently connected by a second linker polypeptide to the N-terminus of the second FokI, and combinations thereof.

Embodiments of this aspect of the present invention include embodiments wherein the length between the second nucleic acid target sequence and the first nucleic acid target sequence is an interspacer distance between about 22 bp to about 40 bp, between about 26 bp to about 36 bp, between about 29 bp to about 35 bp, or between about 30 bp to about 34 bp.

The first FokI and the second FolkI can be monomeric subunits that are capable of associating to form a homodimer, or distinct subunits that are capable of associating to form a heterodimer.

In a preferred embodiment, the guide polynucleotides comprise RNA.

In some embodiments, genomic DNA comprises the PAM of the second nucleic acid target sequence and the PAM of the first nucleic acid target sequence.

In some embodiments, the engineered Type I CRISPR-Cas effector complexes are based on Type I CRISPR-Cas effector complexes of one or more organisms selected from the group consisting of *Salmonella enterica*, Geothermobacter sp. EPR-M, *Methanocella arvoryzae* MRE50, *Streptococcus thermophilus* (strain ND07)), *S. thermophilus*, *Pseudomonas* sp. S-6-2 and *E. coli*. In preferred embodiments, the engineered Type I CRISPR-Cas effector complexes are based on Type I CRISPR-Cas effector complexes of *S. thermophilus*, *Pseudomonas* sp. S-6-2, and/or *E. coli*.

The data presented in Example 18 and Example 20 demonstrate that varying the length of the linker polypeptide used to produce the fusion protein comprising the Cas subunit protein and the FokI and/or varying the length of the interspacer distance between the nucleic acid target sequences to which the spacers are capable of binding facilitate modulation of genome editing efficiency in cells.

Figures 14A, 14B:
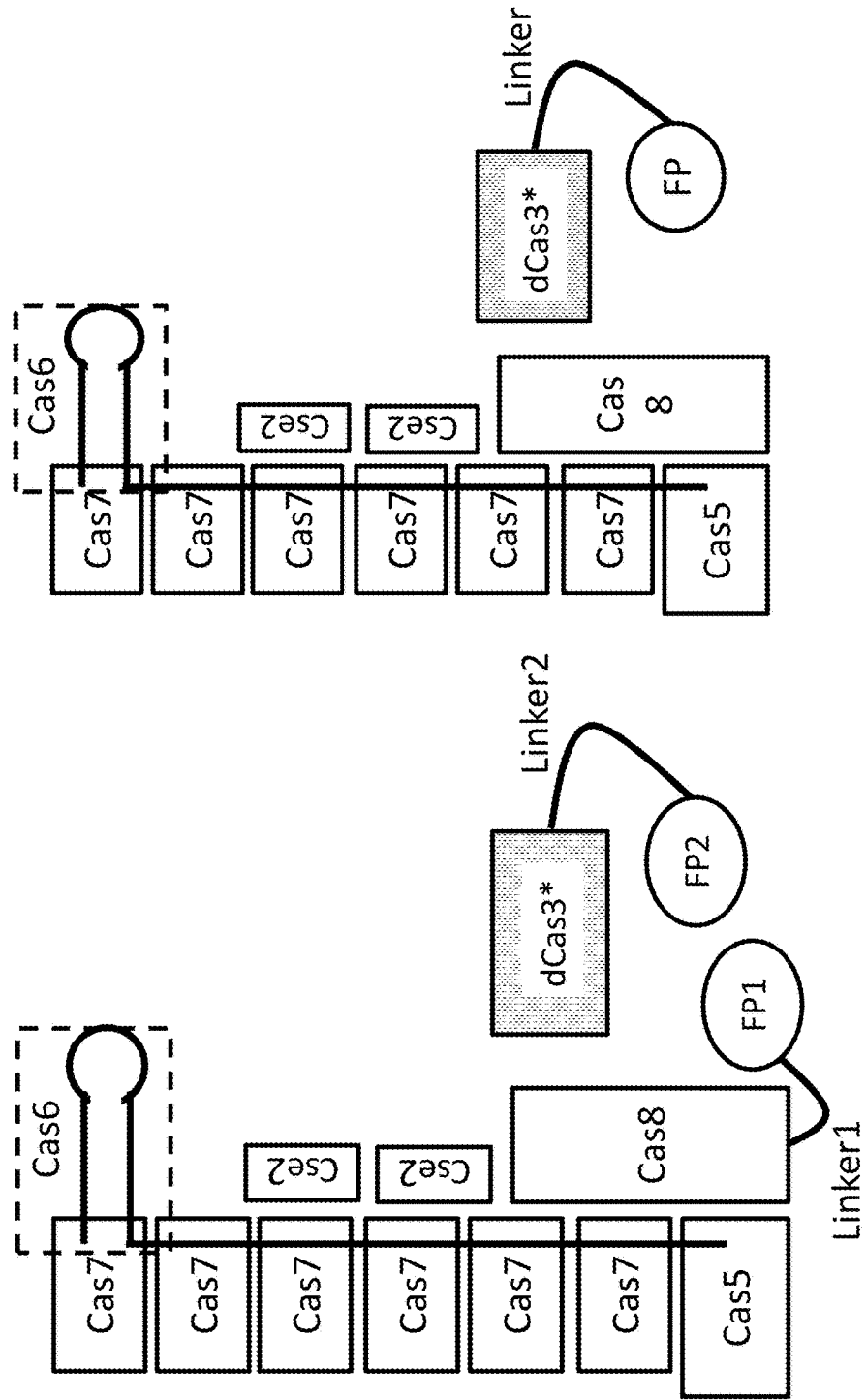

In yet another embodiment, the present invention relates to an engineered Type I CRISPR-Cas effector complex comprising a first fusion protein that comprises a Cascade subunit protein (e.g., a Cas8 subunit protein) and a first functional domain (e.g., FolkI), and a second fusion protein that comprises a dCas3* protein and a second functional domain (e.g., FokI). The engineered Type I CRISPR-Cas effector complex comprising the first functional domain (e.g., FolkI) (FIG. 14A, Cas8-linker1-FP1 fusion) can bind DNA and can then recruit the dCas3*-second functional domain (e.g., FolkI) fusion protein (FIG. 14A, dCas3*-linker2-FP2). In the case where the first functional domain (FIG. 14A, Cas8-linker1-FP1 fusion) and the second functional domain (FIG. 14A, dCas3*-linker2-FP2) comprise subunits of a dimeric protein, the dCas3*-second functional domain (e.g., FolkI) fusion protein binds the engineered Type I CRISPR-Cas effector complex comprising the first functional domain (e.g., FokI) facilitating dimerization of the first functional domain and the second functional domain (FIG. 14A). FIG. 15A illustrates the binding to dsDNA of an engineered Type I CRISPR-Cas effector complex (FIG. 15A, Cascade) comprising the first functional domain (FIG. 15A, FD1) connected to a Cas subunit protein (FIG. 15A, striped box) via a linker polypeptide (FIG. 15A, Linker 1) and a dCas3* connected to a second functional domain (FIG. 15A, FD2) via a linker polypeptide (FIG. 15A, Linker 2) associated with the Cascade complex; thus bringing FD1 and FD2 into proximity and facilitating the interaction of FD1 and FD2. Binding of the Cascade complex involves a single PAM sequence (FIG. 15A, PAM, open box). In the case of the functional domain being a dimeric endonuclease (e.g., FolkI), the proximity of FD1 and FD2 facilitates formation of a functional dimer.

One advantage of this embodiment of the present invention is a single Cascade complex (recognizing a single PAM sequence) can be used to cleave a double-stranded nucleic acid target sequence, versus using two FolkI-Cascade complexes (FIG. 15A compare FIG. 2A, FIG. 2B, and FIG. 2C). Using two FolkI-Cascade complexes requires two PAM sequences in the proper orientation (FIG. 2A, FIG. 2B, and FIG. 2C), which can limit selection of proximal nucleic acid target sequences.

The length and/or composition of the linker polypeptide used to produce the fusion protein comprising a Cas subunit protein and an endonuclease (e.g., FolkI), as well as the length and/or composition of the linker polypeptide used to produce the fusion protein comprising a dCas3* protein and an endonuclease can be varied to modulate genome editing efficiency. Example 21 describes the design and testing of multiple Cas3-FokI linker compositions and lengths and FokI-Cas8 linker compositions and lengths for modulation of genome editing efficiency.

Another embodiment of this aspect of the invention comprises an engineered Type I CRISPR-Cas effector complex and a fusion protein comprising a dCas3* protein and a functional domain (e.g., cytidine deaminase) connected by a linker polypeptide (FIG. 14B, dCas3*, Linker, and FP). The engineered Type I CRISPR-Cas effector complex can bind DNA and recruit the dCas3*-functional domain (e.g., cytidine deaminase) fusion protein. This embodiment can facilitate site-specific targeting of a nucleic acid target sequence for modification by, or interaction with, a functional domain. In the case of cytidine deaminase, an engineered Type I CRISPR-Cas effector complex and a fusion protein that comprises a dCas3* protein and cytidine deaminase can be used for site-specific base editing in a nucleic acid target sequence. FIG. 15B illustrates an example of an engineered Type I CRISPR-Cas effector complex (FIG. 15B, Cascade) comprising a fusion protein comprising a dCas3* protein (FIG. 15B, dCas3*) connected with a functional domain (FIG. 15B, FD) via a linker polypeptide (FIG. 15B, Linker), wherein the complex is bound to dsDNA. In FIG. 15B, contact of the functional domain with dsDNA is facilitated. FIG. 15C illustrates another example of an engineered Type I CRISPR-Cas effector complex (FIG. 15C, Cascade) comprising a fusion protein comprising a dCas3* protein (FIG. 15C, dCas3*) connected with a functional domain (FIG. 15C, FD) via a linker polypeptide (FIG. 15C, Linker), wherein the complex is bound to dsDNA. In FIG. 15C, contact of the functional domain with ssDNA is facilitated.

Some embodiments of the invention can use an engineered Type I CRISPR-Cas effector complex and mutant form of Cas3 lacking ATPase and/or helicase activity (e.g., the Cas3 can be a nickase). The engineered Type I CRISPR-Cas effector complexes can bind DNA and then recruit the ATPase or helicase mutant form of Cas3. This embodiment can facilitate site-specific cleavage of genomic DNA by a mutant form of Cas3.

Additional functional domains and proteins that can be used to construct fusion proteins with Type I CRISPR-Cas subunit proteins are described in the present Specification and Examples. Linker polypeptide compositions and lengths for Cas3-linker polypeptide-functional domain fusion proteins can be evaluated following the guidance of Example 21 and the present Specification to evaluate effects on the performance of the functional domain.

In a ninth aspect, the present invention relates to methods of using engineered Type I CRISPR-Cas effector complexes.

In one embodiment, the present invention includes a method of binding a nucleic acid target sequence in a polynucleotide (e.g., dsDNA) comprising providing one or more engineered Type I CRISPR-Cas effector complexes for introduction into a cell or a biochemical reaction and introducing the engineered Type I CRISPR-Cas effector complex(es) into the cell or biochemical reaction, thereby facilitating contact of the engineered Type I CRISPR-Cas effector complex(es) with the polynucleotide. In one embodiment, a first engineered Type I CRISPR-Cas effector complex comprises a guide complementary to a first nucleic acid target sequence in the polynucleotide and a second engineered Type I CRISPR-Cas effector complex comprises a guide complementary to a second nucleic acid target sequence in the polynucleotide. In another embodiment, an engineered Type I CRISPR-Cas effector complex comprises a guide complementary to a nucleic acid target sequence in the polynucleotide and further comprises a dCas3* fusion protein capable of associating with the complex. Contact of the complex(es) with the polynucleotide results in binding of the engineered Type I CRISPR-Cas effector complex(es) to the nucleic acid target sequence(s) in the polynucleotide. In one embodiment, a first engineered 1 Type I CRISPR-Cas effector complex binds to a first nucleic acid target sequence and a second engineered Type I CRISPR-Cas effector complex binds to a second nucleic acid target sequence in the polynucleotide. In another embodiment, an engineered Type I CRISPR-Cas effector complex binds to a nucleic acid target sequence in the polynucleotide, and the effector complex comprises a dCas3* fusion protein associated with the complex.

Such methods of binding a nucleic acid target sequence can be carried out in vitro (e.g., in a biochemical reaction or in cultured cells; in some embodiments, the cultured cells are human cultured cells that remain in culture and are not introduced into a human); in vivo (e.g., in cells of a living organism, with the proviso that, in some embodiments, the organism is a non-human organism); or ex vivo (e.g., cells removed from a subject, with the proviso that, in some embodiments, the subject is a non-human subject).

A variety of methods are known in the art to evaluate and/or quantitate interactions between nucleic acid sequences and polypeptides including, but not limited to, the following: immunoprecipitation (ChIP) assays, DNA electrophoretic mobility shift assays (EMSA), DNA pull-down assays, and microplate capture and detection assays. Commercial kits, materials, and reagents are available to practice many of these methods and, for example, can be obtained from the following suppliers: Thermo Scientific (Wilmington, Del.), Signosis (Santa Clara, Calif.), Bio-Rad (Hercules, Calif.), and Promega (Madison, Wis.). A common approach to detect interactions between a polypeptide and a nucleic acid sequence is EMSA (see, e.g., Hellman L. M., et al., Nature Protocols 2(8):1849-1861 (2007)).

Figure 16A:
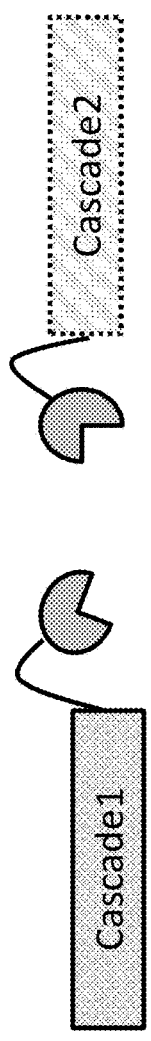
Figure 16B:
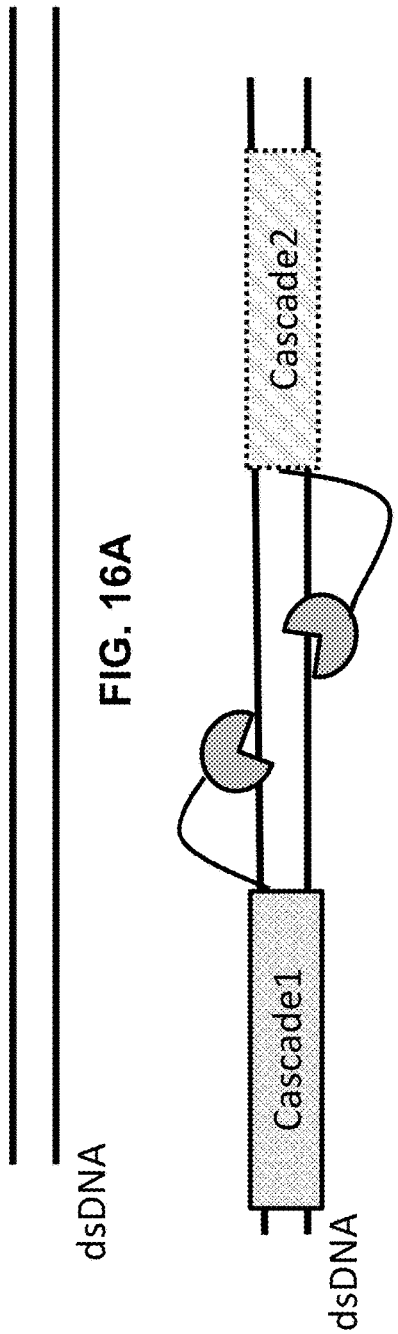
Figure 16C:
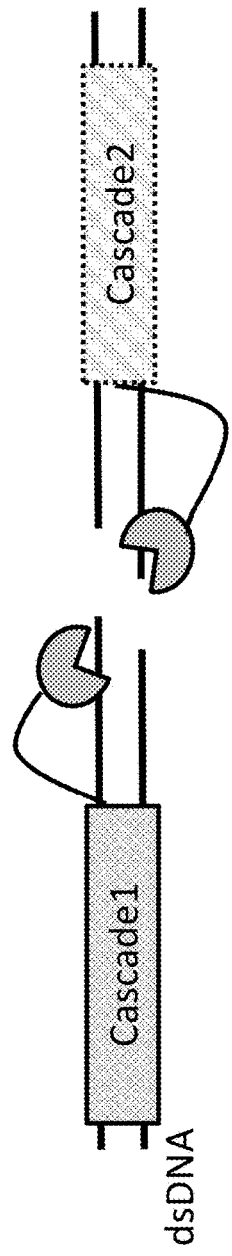

In another embodiment, the present invention includes a method of cutting a nucleic acid target sequence in a polynucleotide (e.g., a single-strand cut in dsDNA or double-strand cut in dsDNA) comprising providing one or more engineered Type I CRISPR-Cas effector complexes for introduction into a cell or biochemical reaction, and introducing the engineered Type I CRISPR-Cas effector complex(es) into the cell or biochemical reaction, thereby facilitating contact of the engineered Type I CRISPR-Cas effector complex(es) with the polynucleotide. In one embodiment, a first engineered Type I CRISPR-Cas effector complex comprising a guide complementary to a first nucleic acid target sequence in the polynucleotide and a first nuclease domain (e.g., FokI) (FIG. 16A, Cascade1), and a second engineered Type I CRISPR-Cas effector complex comprising a guide complementary to a second nucleic acid target sequence in the polynucleotide and a second nuclease domain (e.g., FokI) (FIG. 16A, Cascade 2) are introduced into the cell or biochemical reaction. In another embodiment, an engineered Type I CRISPR-Cas effector complex comprising a guide complementary to a nucleic acid target sequence in the polynucleotide and a first nuclease domain (e.g., FokI) (FIG. 17A, Cascade), and a dCas3*-second nuclease domain (e.g., FokI) fusion protein (FIG. 17A, dCas3) capable of associating with the complex are introduced into the cell or biochemical reaction. The contacting results in cutting of the nucleic acid target sequence(s) in the polynucleotide (e.g., a dsDNA) by the engineered Type I CRISPR-Cas effector complex(es). In one embodiment, the first engineered 1 Type I CRISPR-Cas effector complex binds to the first nucleic acid target sequence in dsDNA (FIG. 16B, Cascade1) and cleaves the first strand of a dsDNA (FIG. 16C, Cascade 1), and the second engineered Type I CRISPR-Cas effector complex binds to the second nucleic acid target sequence in dsDNA (FIG. 16B, Cascade2) and cleaves the second strand of a dsDNA (FIG. 16C, Cascade2). In another embodiment, the engineered Type I CRISPR-Cas effector complex binds to a nucleic acid target sequence in dsDNA (FIG. 17B, Cascade) and cleaves the first strand of a dsDNA (FIG. 17C, Cascade), and the dCas3* fusion protein associates with the complex (FIG. 17B, dCas3*) and cleaves the second strand of the dsDNA (FIG. 17C, dCas3*).

Figure 18A:
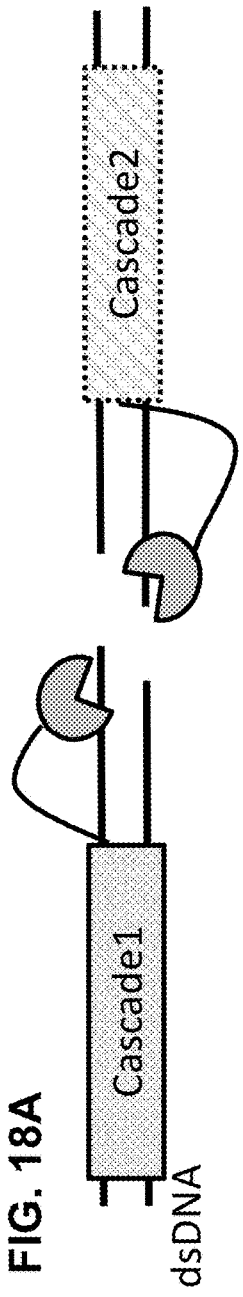
Figure 18B:
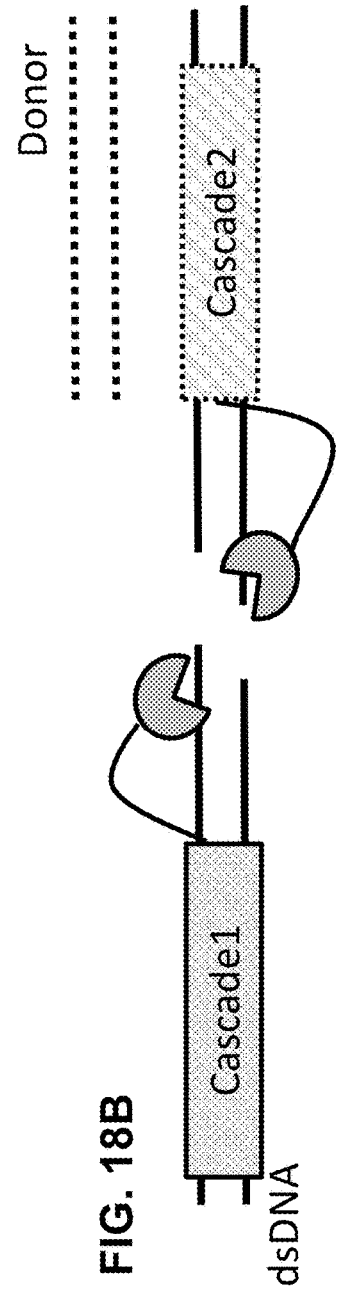
Figure 18C:
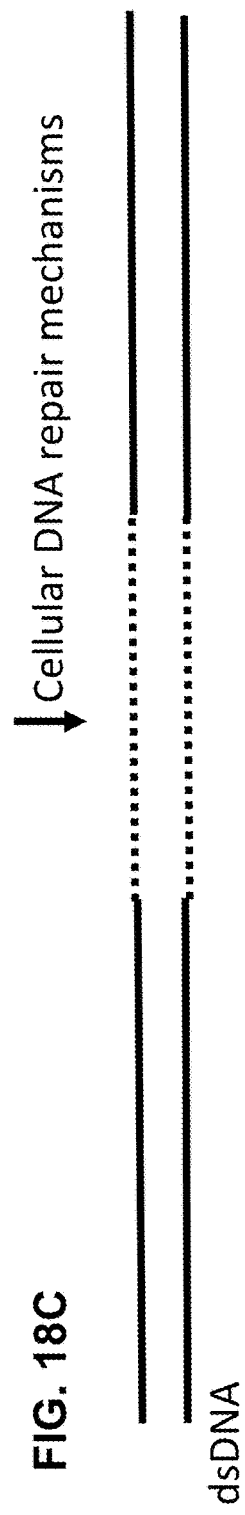

In an additional embodiment of the method of cutting a nucleic acid target sequence in a polynucleotide, a donor polynucleotide can also be introduced into a cell to facilitate incorporation of at least a portion of the donor polynucleotide into genomic DNA of the cell. FIG. 18A illustrates an example of both strands of a dsDNA being cleaved by a first engineered Type I CRISPR-Cas effector complex comprising a guide complementary to a first nucleic acid target sequence in the polynucleotide and a first nuclease domain (e.g., FokI) (FIG. 18A, Cascade1), and a second engineered Type I CRISPR-Cas effector complex comprising a guide complementary to a second nucleic acid target sequence in the polynucleotide and a second nuclease domain (e.g., FokI) (FIG. 18A, Cascade 2). FIG. 18B illustrates a donor polynucleotide comprising homology arms complementary to DNA sequences adjacent the double-strand cut site (FIG. 18B, Donor, dashed lines). FIG. 18C illustrates incorporation of a portion of the donor polynucleotide (FIG. 18C dashed lines) at the double-strand cut site. Incorporation of the donor polynucleotide is mediated by cellular DNA repair mechanisms (e.g., homology-directed repair).

In other embodiments, an engineered Type I CRISPR-Cas effector complex comprising a guide complementary to a first nucleic acid target sequence in a polynucleotide and a first nuclease domain can be paired with a second component comprising a second nuclease domain, wherein the second component is capable of binding to a second nucleic acid target sequence in the polynucleotide. Examples of such second components include, a transcription activator-like effector nuclease (TALEN) comprising the second nuclease domain, a zinc finger comprising the second nuclease domain, or a dCas9/NATNA complex comprising the second nuclease domain.

In some embodiments, the nucleic acid target sequence is dsDNA (e.g., genomic) DNA. In some embodiments, the nucleic acid target sequence is double-stranded and one or both of the strands is cut. Such methods of cutting a nucleic acid target sequence can be carried out in vitro, in vivo, or ex vivo.

Figures 19A, 19B, 19C, 19D:
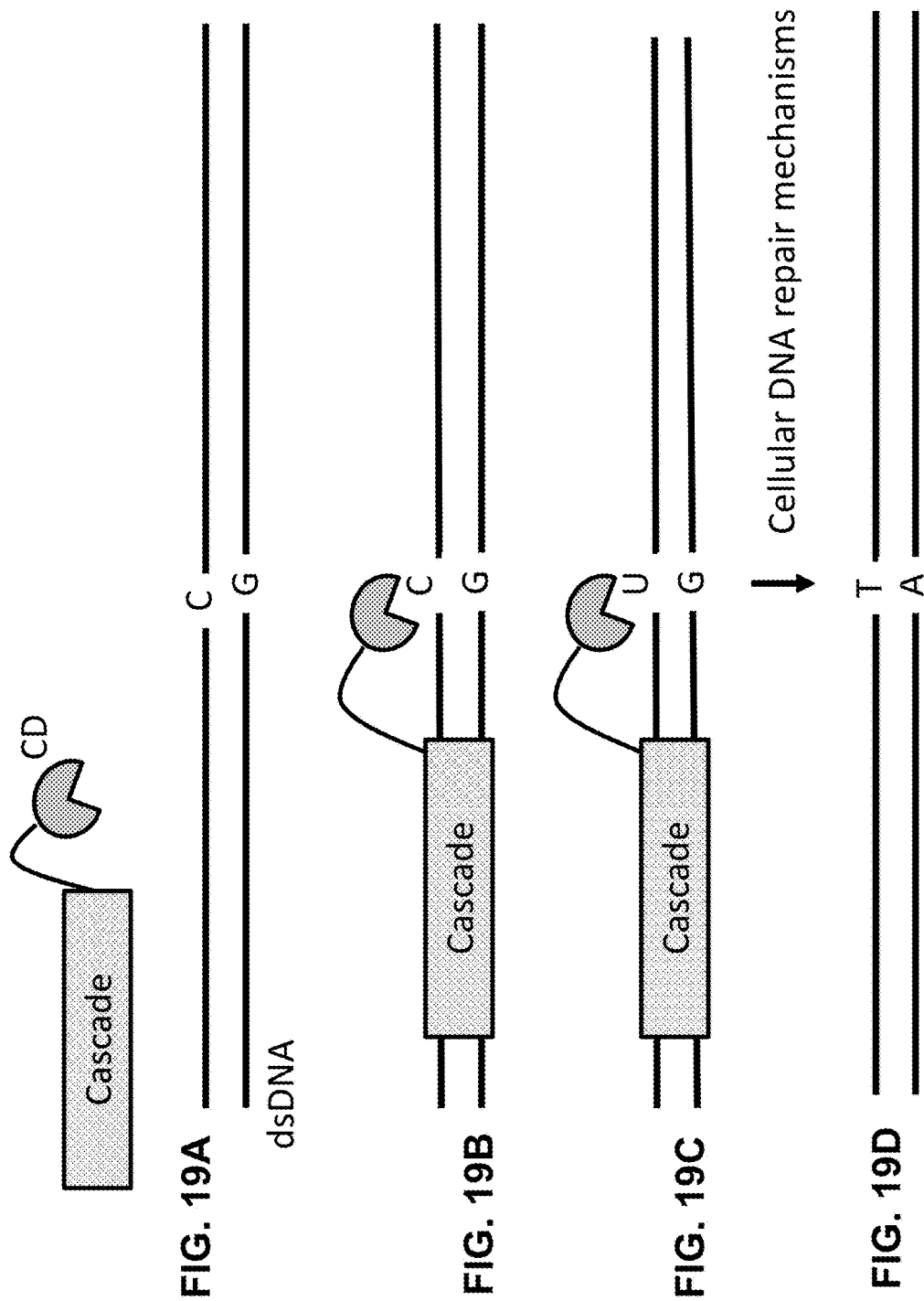

In yet another embodiment, the present invention includes a method of modifying one or more nucleic acid target sequences in a polynucleotide (e.g., DNA) in a cell or biochemical reaction comprising providing one or more engineered Type I CRISPR-Cas effector complexes (e.g., comprising a Cas subunit protein-cytidine deaminase fusion protein) for introduction into the cell or the biochemical reaction, and introducing the engineered Type I CRISPR-Cas effector complex(es) into the cell or biochemical reaction, thereby facilitating contact of the engineered Type I CRISPR-Cas effector complex(es) with the polynucleotide resulting in binding of the engineered Type I CRISPR-Cas effector complex(es) to the nucleic acid target sequence(s) in the polynucleotide that facilitates modification of the nucleic acid target sequence(s) (e.g., C-to-T, G-to-A, A-to-G, and T-to-C). FIG. 19A to FIG. 19D illustrate an example of using a Cascade complex comprising a Cas subunit protein-linker polypeptide-cytidine deaminase fusion protein (Cascade/CD complex) to modify a target nucleotide in genomic DNA of a cell. The Cascade/CD complex (FIG. 19A) is introduced into the cell. The Cascade/CD complex comprises a guide complementary to a DNA target sequence adjacent a target cytosine (FIG. 19B, C). The Cascade/CD complex binds the DNA target sequence (FIG. 19B) and the cytidine deaminase converts the cytosine to a uracil (FIG. 19C). Cellular repair mechanisms can then repair the uracil to a thymidine, and change the mismatched guanidine to adenine (FIG. 19D).

In yet another embodiment, the present invention includes methods of modulating in vitro or in vivo transcription, for example, transcription of a gene comprising regulatory element sequences. Such methods comprise providing one or more engineered Type I CRISPR-Cas effector complexes (e.g., comprising a Cas subunit protein-transcription factor fusion protein) for introduction into the cell or the biochemical reaction, and introducing the engineered Type I CRISPR-Cas effector complex(es) into the cell or biochemical reaction, thereby facilitating contact of the engineered Type I CRISPR-Cas effector complex(es) with the regulatory element sequences resulting in binding of the engineered Type I CRISPR-Cas effector complex(es) to the regulatory element sequences thereby facilitating modulating in vitro or in vivo transcription of the gene comprising the regulatory element sequences.

Figure 20B:
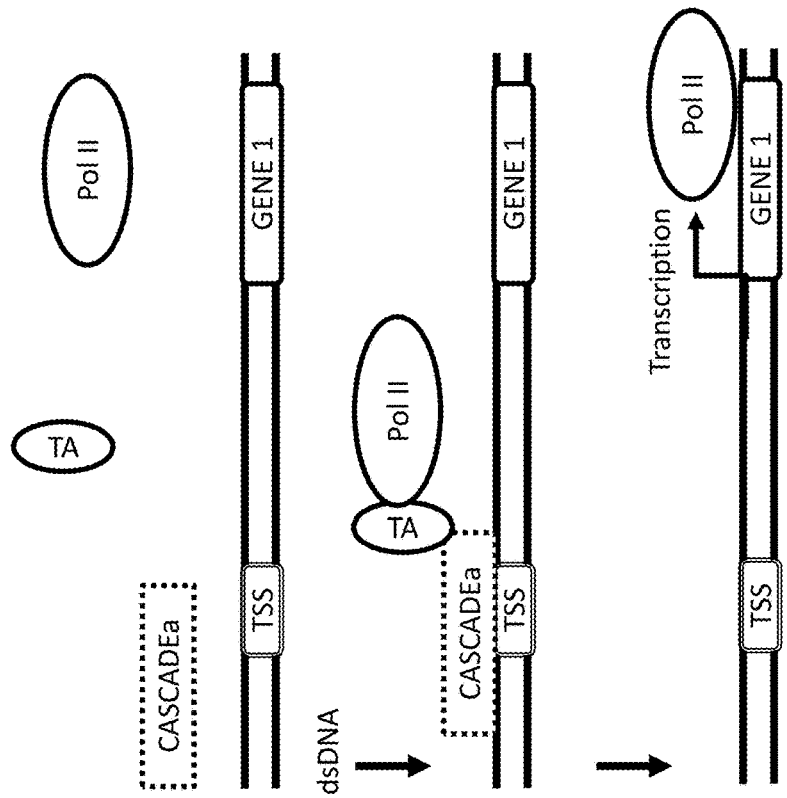
Figure 20A:
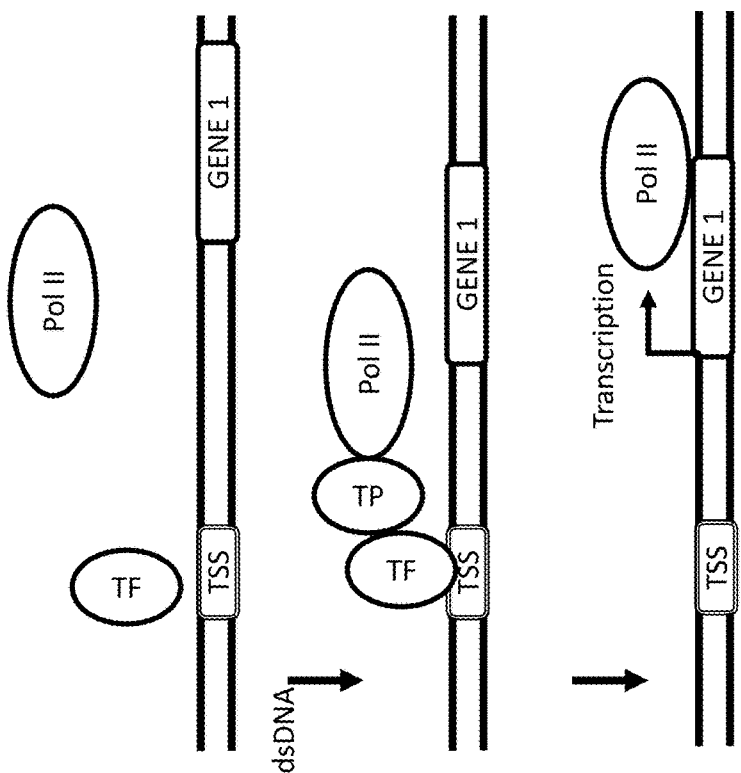

FIG. 20A and FIG. 20B present general illustrations of examples for the transcriptional activation of a generic gene ("GENE1"). FIG. 20A provides an overview of transcriptional regulation of an endogenous gene in a eukaryotic cell. In FIG. 20A, the two dark parallel lines represent double-stranded DNA, the location of Gene 1 (FIG. 20A, GENE 1) is indicated, as well as the transcriptional start site (FIG. 20A, TSS) associated with Gene 1. In the first panel of FIG. 20A, a transcription factor (FIG. 20A, TF) that is needed for the transcriptional activation of Gene 1 and polymerase II (FIG. 20A, Pol II) are illustrated as not yet associated with Gene1-TSS. The second panel illustrates association of the TF with its cognate TSS. The TF then recruits a transcription activation protein (TP) that then recruits RNA Polymerase II (Pol II). Typically, in eukaryotes the TF factor and the TP form a complex comprising multiple proteins and possibly other molecules. The third panel illustrates the resulting transcription of Gene 1 by Pol II. This type of transcriptional activation is typically dependent on TF(s) that are specific to the expression of a gene(s). FIG. 20B presents an illustration of one embodiment of the present invention, wherein a Cascade complex is modified with a protein or factor (FIG. 20B, CASCADEa) that attracts one or more components in the cells responsible for transcriptional activation (Transcriptional Activation factor; FIG. 20B, TA). An example of one such protein or factor is the protein vp64. CASCADEa comprises a guide that is capable of binding at or near the TSS (FIG. 20B, TSS). In FIG. 20B, the two dark parallel lines represent double-stranded DNA, the location of Gene 1 (FIG. 20B, GENE 1) is indicated, as well as the transcriptional start site (TSS) associated with Gene 1. In the first panel of FIG. 20B, CASCADEa and polymerase II (FIG. 20B, Pol II) are illustrated as not yet associated with Gene1-TSS. The second panel illustrates association of CASCADEa with its target, the TSS. The CASCADEa then recruits a transcription activation protein (FIG. 20B, TA) that then recruits RNA Polymerase II (FIG. 20B, Pol II). The third panel illustrates the resulting transcription of Gene 1 by Pol II. One advantage of this embodiment of the present invention is that transcriptional activation of a gene is not dependent on endogenous transcription factors that bind to the TSS of the gene, rather the TSS of a gene can be targeted by selection of an appropriate Cascade guide.

FIG. 21A and FIG. 21B present a general illustration of an example for the transcriptional repression of a generic gene (FIG. 21A, GENE 1) using a Cascade complex comprising a Cas subunit protein-KRAB domain fusion and a guide (FIG. 21A, CASCADEi) complementary to regulatory sequences (FIG. 21A, promoter) associated with GENE 1. Binding of CASCADEi to the regulatory sequences (FIG. 21B) results in transcriptional repression of GENE 1.

In yet another aspect, the present invention relates to using Type I CRISPR systems and Cas3 to delete nucleic acid target sequences in a 3' to 5' manner. This method can be used to make long range deletions of a specific length and can be useful for creation of gene knockouts.

Figures 22A, 22B, 22C, 22D:
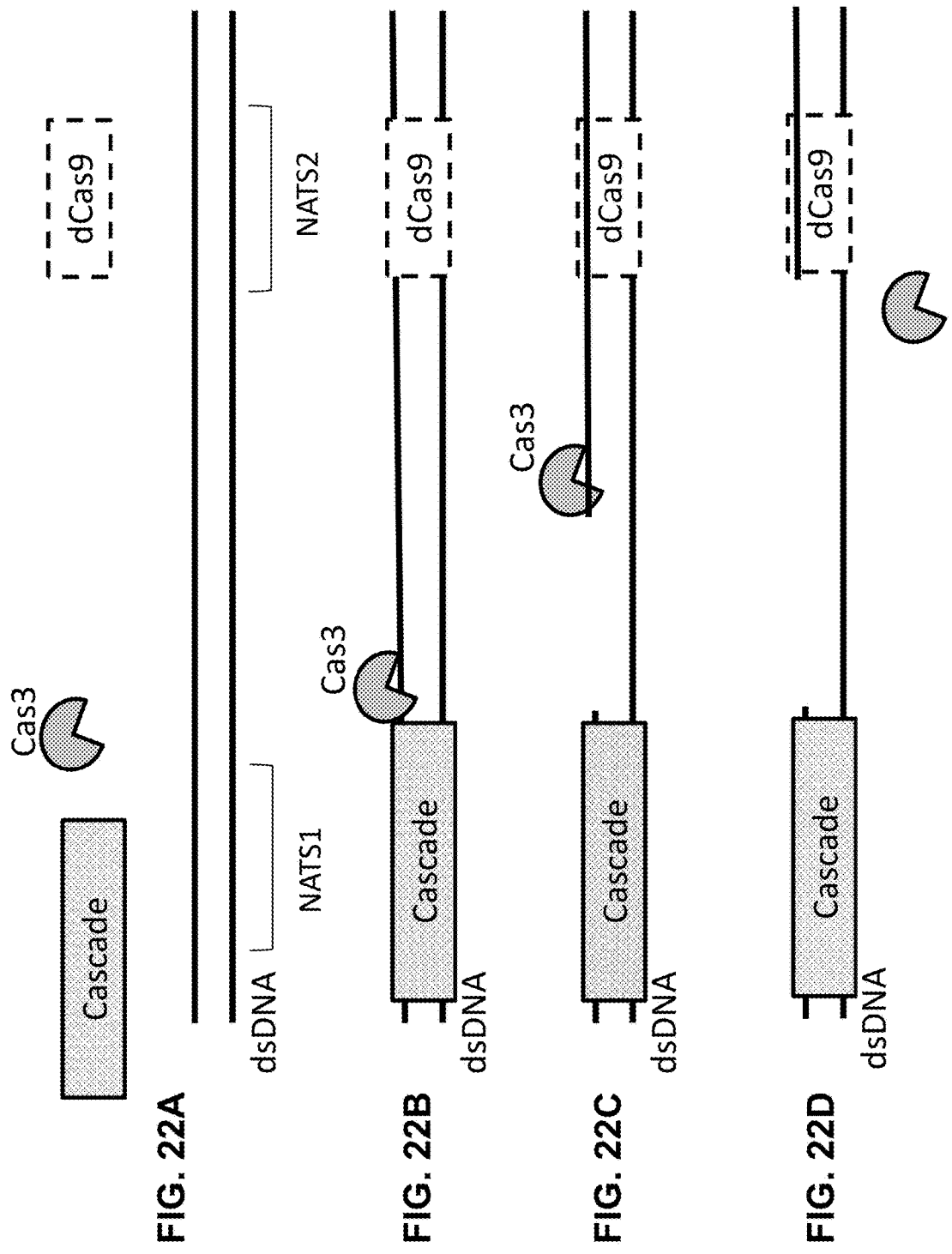

In one embodiment, a region of a target polynucleotide (e.g., genomic DNA) can be deleted using a combination of a Cascade complex comprising a guide complementary to a first nucleic acid target sequence in the target polynucleotide and a dCas9/NATNA complex wherein the NATNA comprises a spacer sequence complementary to a second nucleic acid target sequence in the target polynucleotide. The first and second nucleic acid target sequences are selected to flank the nucleic acid target sequence targeted for deletion. A Cas3 protein comprising an active endonuclease activity associates with the Cascade complex and then progressively deletes a single strand of the dsDNA comprising the nucleic acid target sequence targeted for deletion. When the Cas3 protein collides with the dCas9/NATNA complex, the Cas3 nuclease activity can be stopped at the second nucleic acid target sequence by the dCas9/NATNA complex. FIG. 22A to FIG. 22D illustrate an example of a Cas3 deletion of a nucleic acid target sequence. FIG. 22A shows a dsDNA comprising nucleic acid target sequence 1 (FIG. 22A, NATS1) and nucleic acid target sequence 2 (FIG. 22A, NATS2) that flank the nucleic acid target sequence targeted for deletion. FIG. 22A shows the Cascade complex comprising a guide complementary to NATS1 (FIG. 22A, Cascade), the Cas3 protein (FIG. 22A, Cas3), and the dCas9/NATNA complex comprising a spacer complementary to NATS2 (FIG. 22A, dCas9). FIG. 22B shows binding of the Cascade complex to NATS1, association of the Cas3 protein with the Cascade complex, and binding of the dCas9/NATNA complex to NATS2. FIG. 22C illustrates the progressive deletion by Cas3 of a single strand of the nucleic acid target sequence targeted for deletion. FIG. 22D shows the dissociation of the Cas3 protein from the dsDNA at the position of the dCas9/NATNA complex bound to NATS2.

In another embodiment, a region of a target polynucleotide (e.g., genomic DNA) can be deleted using a combination of a first Cascade complex comprising a guide complementary to a first nucleic acid target sequence in the target polynucleotide and a second Cascade complex comprising a guide complementary to a second nucleic acid target sequence in the target polynucleotide. The first and second nucleic acid target sequences are selected to flank the nucleic acid target sequence targeted for deletion. Cas3 proteins comprising active endonuclease activity associate with each Cascade complex and then progressively delete both strands of the nucleic acid target sequence targeted for deletion. When each Cas3 protein collides with one of the Cascade complexes, the Cas3 nuclease activity can be stopped at the first and second nucleic acid target sequences by the Cascade complexes. FIG. 23A to FIG. 23D illustrate an example of a Cas3 deletion of both strands of a nucleic acid target sequence. FIG. 23A shows a dsDNA comprising nucleic acid target sequence 1 (FIG. 23A, NATS1) and nucleic acid target sequence 2 (FIG. 23A, NATS2) that flank the nucleic acid target sequence targeted for deletion. FIG. 23A shows the first Cascade complex comprising a guide complementary to NATS1 (FIG. 23A, Cascade 1), the Cas3 proteins (FIG. 23A, Cas3), and the second Cascade complex comprising a guide complementary to NATS2 (FIG. 23A, Cascade2). FIG. 23B shows binding of the Cascade complexes to NATS1 and NATS2, as well as association of the Cas3 proteins with the Cascade complexes. FIG. 23C illustrates the progressive deletion by Cas3 of both strands of the nucleic acid target sequence targeted for deletion. FIG. 23D shows the dissociation of the Cas3 proteins from the dsDNA at the positions of the Cascade complexes bound to NATS1 and NATS2.

The engineered Type I CRISPR-Cas effector complexes, as described herein, can be incorporated into a kit. In some embodiments, a kit includes a package with one or more containers holding the kit elements, as one or more separate compositions or, optionally if the compatibility of the components allows, as admixture. In some embodiments, a kit also comprises one or more of the following excipients: a buffer, a buffering agent, a salt, a sterile aqueous solution, a preservative, and combinations thereof. Illustrative kits can comprise one or more engineered Type I CRISPR-Cas effector complexes and one or more excipients, or one or more nucleic acid sequences encoding one or more components of engineered Type I CRISPR-Cas effector complexes.

Furthermore, kits can further comprise instructions for using engineered Type I CRISPR-Cas effector complex compositions.

Another aspect of the invention relates to methods of making or manufacturing one or more engineered Type I CRISPR-Cas effector complexes, or components thereof. In one embodiment, a method of making or manufacturing comprises production of engineered Type I CRISPR-Cas effector complexes in a cell and purification of the engineered Type I CRISPR-Cas effector complexes from cell lysates.

Engineered Type I CRISPR-Cas effector complex compositions can further comprise a detectable label, such as a moiety that can provide a detectable signal. Examples of detectable labels include, but are not limited to, an enzyme, a radioisotope, a member of a specific binding pair, a fluorophore (FAM), a fluorescent protein (green fluorescent protein (GFP), red fluorescent protein, mCherry, tdTomato), a DNA or RNA aptamer together with a suitable fluorophore (enhanced GFP (eGFP), "Spinach"), a quantum dot, an antibody, and the like. A large number and variety of suitable detectable labels are well-known to one of ordinary skill in the art.

Cells comprising engineered Type I CRISPR-Cas effector complexes, cells modified through the use of engineered Type I CRISPR-Cas effector complexes, or progeny of such cells can be used as pharmaceutical compositions formulated, for example, with a pharmaceutically acceptable excipient. Illustrative excipients include carriers, stabilizers, diluents, dispersing agents, suspending agents, thickening agents, and the like. The pharmaceutical compositions can facilitate administration of engineered Type I CRISPR-Cas effector complexes to a subject. Pharmaceutical compositions can be administered in therapeutically effective amounts by various forms and routes including, for example, intravenous, subcutaneous, intramuscular, oral, aerosol, parenteral, ophthalmic, and pulmonary administration.

Embodiments of the present invention include, but are not limited to, the following.

Embodiment 1

A composition comprising:
a first engineered Class 1 Type I CRISPR-Cas effector complex comprising,
  a first Cse2 subunit protein, a first Cas5 subunit protein, a first Cas6 subunit protein, and a first Cas7 subunit protein,
  a first fusion protein comprising a first Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FolkI, and wherein the first linker polypeptide has a length of between 10 amino acids to 40 amino acids, and
  a first guide polynucleotide comprising a first spacer capable of binding a first nucleic acid target sequence; and
a second engineered Class 1 Type I CRISPR-Cas effector complex comprising,
  a second Cse2 subunit protein, a second Cas5 subunit protein, a second Cas6 subunit protein, and a second Cas7 subunit protein,
  a second fusion protein comprising a second Cas8 subunit protein and a second FokI, wherein the N-terminus of the second Cas8 subunit protein or the C-terminus of the second Cas8 subunit protein is covalently connected by a second linker polypeptide to the C-terminus or N-terminus, respectively, of the second FolkI, and wherein the second linker polypeptide has a length of between 10 amino acids to 40 amino acids, and
  a second guide polynucleotide comprising a second spacer capable of binding a second nucleic acid target sequence, wherein a protospacer adjacent motif (PAM) of the second nucleic acid target sequence and a PAM of the first nucleic acid target sequence have an interspacer distance between 20 bp to 42 bp.

Embodiment 2

The composition of embodiment 1, wherein the first linker polypeptide has a length of between 15 amino acids and 30 amino acids.

Embodiment 3

The composition of embodiment 2, wherein the first linker polypeptide has a length of between 17 amino acids and 20 amino acids.

Embodiment 4

The composition of any one of embodiments 1-3, wherein the second linker polypeptide has a length of between 15 amino acids and 30 amino acids.

Embodiment 5

The composition of embodiment 4, wherein the second linker polypeptide has a length of between 17 amino acids and 20 amino acids.

Embodiment 6

The composition of any preceding embodiment, wherein the length of the first linker polypeptide and the second linker polypeptide are the same.

Embodiment 7

The composition of any preceding embodiment, wherein the second nucleic acid target sequence and the first nucleic acid target sequence each has an interspacer distance between 22 bp to 40 bp.

Embodiment 8

The composition of embodiment 7, wherein the second nucleic acid target sequence and the first nucleic acid target sequence each has an interspacer distance between 26 bp to 36 bp.

Embodiment 9

The composition of embodiment 8, wherein the second nucleic acid target sequence and the first nucleic acid target sequence each has an interspacer distance between 29 bp to 35 bp.

Embodiment 10

The composition of embodiment 9, wherein the second nucleic acid target sequence and the first nucleic acid target sequence each has an interspacer distance between 30 bp to 34 base bp.

Embodiment 11

The composition of any preceding embodiment, wherein the first FokI and the second FokI are monomeric subunits capable of associating to form a homodimer.

Embodiment 12

The composition of any one of embodiments 1-10, wherein the first FokI and the second FokI are distinct monomeric subunits capable of associating to form a heterodimer.

Embodiment 13

The composition of any preceding embodiment, wherein the N-terminus of the first Cas8 subunit protein is covalently connected by the first linker polypeptide to the C-terminus of the first FokI.

Embodiment 14

The composition of any one of embodiments 1-12, wherein the C-terminus of the first Cas8 subunit protein is covalently connected by a first linker polypeptide to the N-terminus of the first FolkI.

Embodiment 15

The composition of any preceding embodiment, wherein the N-terminus of the second Cas8 subunit protein is covalently connected by the second linker polypeptide to the C-terminus of the second FolkI.

Embodiment 16

The composition of any one of embodiments 1-14, wherein the C-terminus of the second Cas8 subunit protein is covalently connected by a second linker polypeptide to the N-terminus of the second FolkI.

Embodiment 17

The composition of any preceding embodiment, wherein the first Cas8 subunit protein and the second Cas8 subunit protein each comprises identical amino acid sequences.

Embodiment 18

The composition of any preceding embodiment, wherein the first Cse2 subunit protein and the second Cse2 subunit protein each comprises identical amino acid sequences, the first Cas5 subunit protein and the second Cas5 subunit protein each comprises identical amino acid sequences, the first Cas6 subunit protein and the second Cas6 subunit protein each comprises identical amino acid sequences, and the first Cas7 subunit protein and the second Cas7 subunit protein each comprises identical amino acid sequences.

Embodiment 19

The composition of any preceding embodiment, wherein the first guide polynucleotide comprises RNA.

Embodiment 20

The composition of any preceding embodiment, wherein the second guide polynucleotide comprises RNA.

Embodiment 21

The composition of any preceding embodiment, wherein genomic DNA comprises the PAM of the second nucleic acid target sequence and the PAM of the first nucleic acid target sequence.

Embodiment 22

A cell comprising: the composition of any preceding embodiment.

Embodiment 23

The cell of embodiment 22, wherein genomic DNA of the cell comprises the PAM of the second nucleic acid target sequence and the PAM of the first nucleic acid target sequence.

Embodiment 24

The cell of embodiment 22 or 23, wherein the cell is a prokaryotic cell.

Embodiment 25

The cell of embodiment 22 or 23, wherein the cell is a eukaryotic cell.

Embodiment 26

One or more nucleic acid sequences encoding the first Cse2 subunit protein, the first Cas5 subunit protein, the first Cas6 subunit protein, the first Cas7 subunit protein, the first fusion protein, and the first guide polynucleotide of any one of embodiments 1-21.

Embodiment 27

One or more nucleic acid sequences encoding the second Cse2 subunit protein, the second Cas5 subunit protein, the second Cas6 subunit protein, the second Cas7 subunit protein, the second fusion protein, and the second guide polynucleotide of any one of embodiments 1-21.

Embodiment 28

One or more expression cassettes comprising the one or more nucleic acid sequences of embodiment 26, embodiment 27, or embodiment 26 and embodiment 27.

Embodiment 29

One or more vectors comprising the one or more expression cassettes of embodiment 28.

Embodiment 30

A method of binding a polynucleotide comprising the first nucleic acid target sequence and the second nucleic acid target sequence, the method comprising:
providing the composition of any one of embodiments 1-21 for introduction into a cell or a biochemical reaction; and
introducing the composition into the cell or the biochemical reaction, thereby facilitating contact of the first engineered Class 1 Type I CRISPR-Cas effector complex with the first nucleic acid target sequence and contact of the second engineered Class 1 Type I CRISPR-Cas effector complex with the second nucleic acid target sequence, resulting in binding of the first engineered Class 1 Type I CRISPR-Cas effector complex with the first nucleic acid target sequence and binding of the second engineered Class 1 Type I CRISPR-Cas effector complex with the second nucleic acid target sequence in the polynucleotide.

Embodiment 31

The method of embodiment 30, wherein genomic DNA comprises the polynucleotide.

Embodiment 32

A method of cutting a polynucleotide comprising the first nucleic acid target sequence and the second nucleic acid target sequence, the method comprising:
providing the composition of any one of embodiments 1-21 for introduction into a cell or a biochemical reaction; and
introducing the composition into the cell or the biochemical reaction, thereby facilitating contact of the first engineered Class 1 Type I CRISPR-Cas effector complex with the first nucleic acid target sequence and contact of the engineered second Class 1 Type I CRISPR-Cas effector complex with the second nucleic acid target sequence, resulting in cutting of the first nucleic acid target sequence by the first engineered Class 1 Type I CRISPR-Cas effector complex and cutting of the second nucleic acid target sequence by the second engineered Class 1 Type I CRISPR-Cas effector complex.

Embodiment 33

The method of embodiment 32, wherein genomic DNA comprises the polynucleotide.

Embodiment 34

A kit comprising: the composition of any one of embodiments 1-21; and a buffer.

Embodiment 35

A kit comprising: the one or more nucleic acid sequences of embodiment 26, embodiment 27, or embodiment 26 and embodiment 27; and a buffer.

Embodiment 36

A composition comprising:
an engineered Class 1 Type I CRISPR-Cas effector complex comprising,
  a Cse2 subunit protein, a Cas5 subunit protein, a Cas6 subunit protein, and a Cas7 subunit protein,
  a first fusion protein comprising a Cas8 subunit protein and a first FolkI, wherein the N-terminus of the first Cas8 subunit protein or the C-terminus of the first Cas8 subunit protein is covalently connected by a first linker polypeptide to the C-terminus or N-terminus, respectively, of the first FolkI, and
  a guide polynucleotide comprising a spacer capable of binding a nucleic acid target sequence; and
a second fusion protein comprising an engineered Class 1 Type I CRISPR-Cas3 fusion protein comprising a dCas3* protein and a second FolkI, wherein the N-terminus of the dCas3* protein or the C-terminus of the dCas3* protein is covalently connected by a second linker polypeptide to the C-terminus or N-terminus, respectively, of the second FolkI, and wherein the first linker polypeptide has a length of between 10 amino acids to 40 amino acids, effector complex comprising,

Embodiment 37

The composition of embodiment 36, wherein the first linker polypeptide has a length of between 5 amino acids to 40 amino acids.

Embodiment 38

The composition of embodiment 36, wherein the first linker polypeptide has a length of between 5 amino acids to 40 amino acids.

Embodiment 39

A cell comprising: the composition of any one of embodiments 36 to 38.

Embodiment 40

The cell of embodiment 39, wherein the cell is a prokaryotic cell.

Embodiment 41

The cell of embodiment 39, wherein the cell is a eukaryotic cell.

Embodiment 42

One or more nucleic acid sequences encoding the Cse2 subunit protein, the Cas5 subunit protein, the Cas6 subunit protein, the Cas7 subunit protein, the first fusion protein, and the guide polynucleotide of any one of embodiments 36 to 38.

Embodiment 43

One or more nucleic acid sequences encoding the second fusion protein of any one of embodiments 36 to 38.

Embodiment 44

One or more expression cassettes comprising the one or more nucleic acid sequences of embodiment 42, embodiment 43, or embodiment 42 and embodiment 43.

Embodiment 45

One or more vectors comprising the one or more expression cassettes of embodiment 44.

Embodiment 46

A method of binding a polynucleotide comprising the nucleic acid target sequence, the method comprising:
providing the composition of any one of embodiments 36 to 38 for introduction into a cell or a biochemical reaction; and
introducing the composition into the cell or the biochemical reaction, thereby facilitating contact of the engineered Class 1 Type I CRISPR-Cas effector complex with the nucleic acid target sequence and contact of the second fusion protein with the engineered Class 1 Type I CRISPR-Cas effector complex, resulting in binding of the engineered Class 1 Type I CRISPR-Cas effector complex and the second fusion protein to the nucleic acid target sequence in the polynucleotide.

Embodiment 47

The method of embodiment 46, wherein genomic DNA comprises the polynucleotide.

Embodiment 48

A method of cutting a polynucleotide comprising the nucleic acid target sequence, the method comprising:
providing the composition of any one of embodiments 36 to 38 for introduction into a cell or a biochemical reaction; and
introducing the composition into the cell or the biochemical reaction, thereby facilitating contact of the first engineered Class 1 Type I CRISPR-Cas effector complex with the first nucleic acid target sequence and contact of the engineered second Class 1 Type I CRISPR-Cas effector complex with the second nucleic acid target sequence,
introducing the composition into the cell or the biochemical reaction, thereby facilitating contact of the engineered Class 1 Type I CRISPR-Cas effector complex with the nucleic acid target sequence and contact of the second fusion protein with the engineered Class 1 Type I CRISPR-Cas effector complex, resulting in cutting of the nucleic acid target sequence by the engineered Class 1 Type I CRISPR-Cas effector complex and the second fusion protein.

Embodiment 49

The method of embodiment 48, wherein genomic DNA comprises the polynucleotide.

Embodiment 50

A kit comprising: the composition of any one of embodiments 36 to 38; and a buffer.

Embodiment 51

A kit comprising: the one or more nucleic acid sequences of embodiment 42, embodiment 43, or embodiment 42 and embodiment 43; and a buffer.

Although preferred embodiments of the present invention have been shown and described herein, it will be obvious to those skilled in the art that such embodiments are provided by way of example only. From the present Specification and the Examples, one skilled in the art can ascertain essential characteristics of this invention, and without departing from the spirit and scope thereof, can make changes, substitutions, variations, and modifications of the invention to adapt it to various usages and conditions. Such changes, substitutions, variations, and modifications are also intended to fall within the scope of the present disclosure.

EXPERIMENTAL

Aspects of the present invention are illustrated in the following Examples. Efforts have been made to ensure accuracy with respect to numbers used (e.g., amounts, concentrations, percent changes, and the like) but some experimental errors and deviations should be accounted for. Unless indicated otherwise, temperature is in degrees Centigrade and pressure is at or near atmospheric. It should be understood that these Examples are given by way of illustration only and are not intended to limit the scope of the present invention.

Example 1

In Silico Design of Polynucleotides Encoding Cascade Components

This Example provides a description of the design of polynucleotide components encoding Cascade using gene, protein, and CRISPR sequences derived from a Type I-E CRISPR-Cas system.

Table 10 presents polynucleotide DNA sequences of genes encoding the five proteins of Cascade from Type I-E, specifically from *E. coli* strain K-12 MG1655, as well as the amino acid sequences of the resulting protein components. Genomic sequences were obtained from NCBI Reference Sequence NZ_CP014225.1. In the Table, polynucleotide sequences were either amplified from *E. coli* genomic DNA or manufacturer-produced polynucleotides encoding Cascade protein components that were codon optimized specifically for expression in *E. coli* and also for expression in human cells.

In addition, several fusion proteins comprising Cascade proteins were designed. Table 11 presents polynucleotide DNA sequences of genes encoding Cascade protein fusion proteins, as well as the amino acid sequences of the resulting protein components. In most instances, fusion proteins described in Table 11 include short tri-amino acid linkers connecting the two polypeptide sequences within the fusion construct; this linker typically comprises glycine-glycine-serine (GGS) or glycine-serine-glycine (GSG). The exact tri-amino acid linker sequences used in each particular fusion protein can be found in the full-length amino acid sequence in Table 11.

TABLE 11

Cascade Fusion Protein Sequences

| Cascade protein | Heterologous polypeptide | Heterologous polypeptide fused to the N- or C-terminus of the Cascade protein | DNA coding sequence | Expression system for DNA coding sequence | Amino acid sequence |
|---|---|---|---|---|---|
| Cas6 | NLS | N | SEQ ID NO: 398 | *E. coli* | SEQ ID NO: 399 |
| Cas6 | NLS-HA | N | SEQ ID NO: 400 | *E. coli* | SEQ ID NO: 401 |
| Cas6 | NLS | N | SEQ ID NO: 402 | Mammalian | SEQ ID NO: 403 |
| Cas7 | NLS | C | SEQ ID NO: 404 | *E. coli* | SEQ ID NO: 405 |
| Cas7 | HA-NLS | C | SEQ ID NO: 406 | *E. coli* | SEQ ID NO: 407 |
| Cas7 | NLS | N | SEQ ID NO: 408 | Mammalian | SEQ ID NO: 409 |
| Cas8 | His6-MBP-TEV | N | SEQ ID NO: 410 | *E. coli* | SEQ ID NO: 411 |
| Cas8 | His6-MBP-TEV-NLS-FokI-linker | N | SEQ ID NO: 412 | *E. coli* | SEQ ID NO: 413 |
| Cas8 | NLS | N | SEQ ID NO: 414 | Mammalian | SEQ ID NO: 415 |
| Cas8 | NLS-HA-FokI-linker | N | SEQ ID NO: 416 | Mammalian | SEQ ID NO: 417 |

TABLE 10

Cas Protein DNA and Amino Acid Sequences

| Protein | Type of sequence | DNA coding sequence | Amino acid sequence |
|---|---|---|---|
| Cas8 | genomic | SEQ ID NO: 1 | SEQ ID NO: 16 |
| Cse2 | genomic | SEQ ID NO: 2 | SEQ ID NO: 17 |
| Cas7 | genomic | SEQ ID NO: 3 | SEQ ID NO: 18 |
| Cas5 | genomic | SEQ ID NO: 4 | SEQ ID NO: 19 |
| Cas6 | genomic | SEQ ID NO: 5 | SEQ ID NO: 20 |
| Cas8 | *E. coli* codon-optimized | SEQ ID NO: 6 | SEQ ID NO: 16 |
| Cse2 | *E. coli* codon-optimized | SEQ ID NO: 7 | SEQ ID NO: 17 |
| Cas7 | *E. coli* codon-optimized | SEQ ID NO: 8 | SEQ ID NO: 18 |
| Cas5 | *E. coli* codon-optimized | SEQ ID NO: 9 | SEQ ID NO: 19 |
| Cas6 | *E. coli* codon-optimized | SEQ ID NO: 10 | SEQ ID NO: 20 |
| Cas8 | *H. sapiens* codon-optimized | SEQ ID NO: 11 | SEQ ID NO: 16 |
| Cse2 | *H. sapiens* codon-optimized | SEQ ID NO: 12 | SEQ ID NO: 17 |
| Cas7 | *H. sapiens* codon-optimized | SEQ ID NO: 13 | SEQ ID NO: 18 |
| Cas5 | *H. sapiens* codon-optimized | SEQ ID NO: 14 | SEQ ID NO: 19 |
| Cas6 | *H. sapiens* codon-optimized | SEQ ID NO: 15 | SEQ ID NO: 20 |

The His6 (hexahistidine; SEQ ID NO:418) and Strep-Tag™ II (GE Healthcare Bio-Sciences, Pittsburgh, Pa.) (SEQ ID NO:419) peptide tags on the Cse2 protein, when co-expressed with other Cascade proteins, enable purification of the complex via either Nickel-nitriloacetic acid (Ni-NTA) resin or Strep-Tactin™ (GE Healthcare Bio-Sciences, Pittsburgh, Pa.) resin, respectively. The HRV3C (human rhinovirus 3C) protease recognition sequence (SEQ ID NO:420) is cleaved by an HRV3C protease and can be used to remove N-terminal fusions from a protein of interest. The NLS (nuclear localization signal; SEQ ID NO:421 peptide tag on the Cas6, Cas7, and/or Cas8 proteins enables nuclear trafficking in eukaryotic systems. The HA (hemagglutinin; SEQ ID NO:422) peptide tag on the Cas6 or Cas7 proteins enables detection of heterologous protein expression by Western blotting with an anti-HA antibody. The MBP (maltose binding protein; SEQ ID NO:423) peptide fusion is a solubilization tag that facilitates purification of the Cas8 protein. The TEV (tobacco etch virus) protease recognition sequence (SEQ ID NO:424) is cleaved by TEV protease and can be used to remove N-terminal fusions from a protein of interest. The FokI nuclease domain comprises the Sharkey variant described by Guo, et al. (Guo, J., et al., J. Mol. Biol. 400:96-107 (2010)), two monomeric FokI subunits associate to form a homodimer, and catalyze double-stranded DNA cleavage upon homo-dimerization. A linker sequence (SEQ ID NO:425) is used to fuse the FokI nuclease domain to the Cas8 protein.

Additional linker sequences of varying length and amino acid composition have been designed that connect the FokI nuclease domain to the Cas8 protein. These amino acid sequences can be found in Table 12.

TABLE 12

Amino Acid Linker Sequences

| SEQ ID NO: | Linker length (amino acids) | Amino acid sequence |
| --- | --- | --- |
| SEQ ID NO: 426 | 5 | GGGGS |
| SEQ ID NO: 427 | 8 | TGPGAAAR |
| SEQ ID NO: 428 | 10 | GGSGSSGGSG |
| SEQ ID NO: 429 | 12 | TGPGAAARAASG |
| SEQ ID NO: 430 | 15 | GGSGSSGGSGSSGGS |
| SEQ ID NO: 431 | 16 | SGSETPGTSESATPES |
| SEQ ID NO: 432 | 20 | SGSETPGTSESATPESGGSG |
| SEQ ID NO: 433 | 30 | SGSETPGTSESATPESGGS GSSGGSGSSGG |

Table 13 contains the polynucleotide DNA sequence of four minimal CRISPR arrays that, when transcribed into precursor crRNA and processed by the RNA endonuclease protein of Cascade, generate mature crRNAs that function as the guide RNA to target complementary DNA sequences in biochemical assays and in cell culture gene editing experiments.

The minimal CRISPR array comprises two repeat sequences (underlined, lower case) flanking a spacer sequence, which represents the guide portion of the crRNA. RNA processing by the Cascade endonuclease protein generates a crRNA with repeat sequences on both the 5' and 3' ends, flanking the guide sequence. The CRISPR array may also be expanded to include three repeat sequences (underlined) flanking two spacer sequences, which represent the guide portions of two distinct crRNAs by RNA processing by the endonuclease Cascade protein. The arrays can be further expanded to include additional spacer sequences, if desired.

Example 2

Design of Bacterial Expression Vectors for Production of Cascade Effector Complexes This Example describes the design of bacterial expression vectors that encode the Cascade-associated proteins, as well as a minimal CRISPR array comprising the guide sequence as described in Example 1. The construction of Cascade subunit protein expression systems for use with plasmids encoding minimal CRISPR arrays is described.

A single-plasmid Cascade protein expression system was constructed to express the proteins of either a complex of Cascade in *E. coli*, known as the CasBCDE complex (which contains the Cse2, Cas7, Cas5, and Cas6 proteins, but not the Cas8 protein), or the entire functional Cascade complex in *E. coli*. The single plasmid system comprises either the cse2-cas7-cas5-cas6 operon, or the entire cas8-cse2-cas7-cas5-cas6 operon on a single expression plasmid. The Cas8 protein can be expressed from its own expression plasmid, for use in biochemical experiments where it is mixed together with the CasBCDE complex to reconstitute Cascade.

A starting plasmid for expression vector construction was used (see Brouns, S. J. J. et al., Science 321:960-964 (2008)). The single plasmid Cascade protein expression system comprising a Cas operon was assembled as follows. The coding sequences for the cas genes were arranged in the order cse2-cas7-cas5-cas6 (CasBCDE complex or cas8-cse2-cas7-cas5-cas6 (full Cascade complex), and were separated by sequences corresponding to the wild-type bacterial gene arrangement (see NCBI Reference Sequence NZ_CP014225.1).

In order to append a polynucleotide sequence encoding an affinity tag (His6 or Strep-Tag™ II), the corresponding coding sequence was inserted at the junction of the 3' end of the cas8 gene and the 5' end of the cse2 gene; these two open reading frames overlap in the wild-type genomic DNA sequence.

In order to append polynucleotide sequences encoding N-terminal NLS and/or NLS-HA tags onto the 5' end of the cas6 gene, additional spacing was introduced between the cas6 and upstream cas5 genes, because these open reading frames overlap in the wild-type genomic DNA sequence, such that the Shine-Dalgarno sequence for the cas6 gene is

TABLE 13

CRISPR Array Sequences

| SEQ ID NO: | Cell type | Target | Minimal CRISPR array sequence |
| --- | --- | --- | --- |
| SEQ ID NO: 434 | *E. coli* | Bacteriophage λ J3 target | gagttccccgcgccagcggggataaaccgCCAGTGATA AGTGGAATGCCATGTGGGCTGTCgagttccc cgcgccagcggggataaaccg |
| SEQ ID NO: 435 | *E. coli* | Bacteriophage λ L3 target | gagttccccgcgccagcggggataaaccgAGTGGCAGA TATAGCCTGGTGGTTCAGGCGGCgagttccc cgcgccagcggggataaaccg |
| SEQ ID NO: 436 | *E. coli* | Bacteriophage λ L3/J3 targets | gagttccccgcgccagcggggataaaccgCCAGTGATA AGTGGAATGCCATGTGGGCTGTCgagttccc cgcgccagcggggataaaccgAGTGGCAGATATAG CCTGGTGGTTCAGGCGGCgagttccccgcgccag cggggataaaccg |
| SEQ ID NO: 437 | *H. sapiens* cell | TRAC gene | gagttccccgcgccagcggggataaaccgGTTGATTTG CCTGCATTGGTGTTACACAGTCTgagttcccc gcgccagcggggataaaccgTAAGTTGTGTTCTTC TTTGCCTAGGCCTTCAGgagttccccgcgccagcg gggataaaccg | within the 3' portion of the cas5 gene. A new Shine-Dalgarno sequence was inserted upstream of the new NLS-Cas6 or NLS-HA-Cas6 open reading frames, to improve translational efficiency.

In order to append polynucleotide sequences encoding C-terminal NLS and/or HA-NLS tags onto the 3' end of the cas7 gene, additional spacing was introduced between the cas7 and downstream cas5 genes, because these open reading frames are in close proximity in the wild-type genomic DNA sequence, such that the Shine-Dalgarno sequence for the cas5 gene is within the 3' portion of the cas7 gene. A new Shine-Dalgarno sequence was inserted downstream of the new Cas?-NLS or Cas?-HA-NLS open reading frames, to improve translational efficiency for the cas5 gene.

In order to append polynucleotide sequences encoding N-terminal NLS-FolkI-linker fusions to the Cas8 protein, the corresponding coding sequences were inserted at the 5' end of the cas8 gene.

The cse2-cas7-cas5-cas6 and cas8-cse2-cas7-cas5-cas6 operons were cloned into the pCDF (MilliporeSigma, Hayward, Calif.) vector backbone, which confers spectinomycin resistance due to the presence of the aadA gene. Transcription of the operon is driven by a T7 promoter and is under control of the Lac operator; the vector also encodes the LacI repressor. A T7 terminator was cloned downstream of the cse2-cas7-cas5-cas6 or cas8-cse2-cas7-cas5-cas6 operon. The vector contains a CDF origin of replication.

For expression of Cas8 or FokI-Cas8 fusion proteins, the cas8 gene was cloned into a pET (MilliporeSigma, Hayward, Calif.) family vector backbone, which confers kanamycin resistance due to the presence of the kanR gene. Transcription of the operon is driven by a T7 promoter ($P_{T7}$), and is under control of the Lac operator (lacO); the vector also encodes the LacI repressor (lacI gene). A T7 terminator was cloned downstream of the cas8 gene. The vector contains a ColE1 origin of replication.

FIG. 24A, FIG. 24B, FIG. 24C, FIG. 24D, and FIG. 24E present schematic diagrams of overexpression vectors for the cas8, folkI-cas8, the cse2-cas7-cas5-cas6 operon, the cas8-cse2-cas7-cas5-cas6 operon, and the fokI-cas8-cse2-cas7-cas5-cas6 operon. The designations in FIG. 24A, FIG. 24B, FIG. 24C, FIG. 24D, and FIG. 24E are described in this Example and in Example 1 and are as follows: $P_{T7}$ (T7 promoter), lacO (Lac operator), His6 (hexahistidine), MBP (maltose binding protein), Strep-Tag™ II, HRV3C (human rhinovirus 3C) protease recognition sequence, TEV (tobacco etch virus) protease recognition sequence, NLS (nuclear localization signal), kanR (kanamycin resistance gene), lacI (LacI repressor gene), colE1 ori (origin of replication), CDF ori (CloDF13 origin of replication), FolkI nuclease domain (Sharkey variant), and aadA (gene encoding aminoglycoside resistance protein).

Table 14 provides sequences of bacterial expression plasmids encoding the Cas8 protein, the 4 proteins of the CasBCDE complex (cse2-cas7-cas5-cas6 operon), and all 5 proteins of the Cascade complex (cas8-cse2-cas7-cas5-cas6 operon). Polynucleotide sequences are provided with and without the N-terminal FolkI fusion on the Cas8 protein.

TABLE 14

Bacterial Plasmid Sequences

| SEQ ID NO: | Vector designation | Arrangement of protein coding sequences (N to C) | Notable characteristics |
|---|---|---|---|
| SEQ ID NO: 438 | Cas8 expression vector | His6-MBP-TEV-Cas8 | Can be added to CasBCDE complex to reconstitute Cascade |
| SEQ ID NO: 439 | FokI-Cas8 expression vector | His6-MBP-TEV-NLS-Fok1-linker-Cas8 | FokI confers the ability to cleave double-stranded DNA |
| SEQ ID NO: 440 | CasBCDE complex expression vector | Strep-tag ™ II-HRV3C-Cse2_Cas7_Cas5_Cas6 | When co-expressed with a CRISPR array, generates CasBCDE complex |
| SEQ ID NO: 441 | Cascade complex expression vector | Cas8_His6-HRV3C-Cse2_Cas7_Cas5_Cas6 | When co-expressed with a CRISPR array, generates Cascade complex |
| SEQ ID NO: 442 | FokI-Cascade expression vector | NLS-FokI-linker-Cas8_His6-HRV3C-Cse2_Cas7_Cas5_Cas6 | FokI confers the ability to cleave double-stranded DNA targeted by crRNA |
| SEQ ID NO: 443 | FokI-Cascade expression vector, extra NLS tag | NLS-FokI-linker-Cas8_His6-HRV3C-Cse2_Cas7-NLS_Cas5_Cas6 | FokI confers the ability to cleave double-stranded DNA targeted by crRNA; extra NLS tag on Cas7 protein improves nuclear trafficking |

In order to purify the CasBCDE complex and Cascade complex containing a crRNA, the protein expression vectors encoding the cse2-cas7-cas5-cas6 operon or the cas8-cse2-cas7-cas5-cas6 operon are combined with a vector containing a minimal CRISPR array.

CRISPR arrays were cloned into the pACYC-Duet1 vector backbone, which confers chloramphenicol resistance due to the camR gene. Transcription of the array is driven by a T7 promoter and is under control of the Lac operator (lacO); the vector also encodes the LacI repressor. A T7 terminator was cloned downstream of the CRISPR array. The vector contains a p15A origin of replication.

Figure 25:
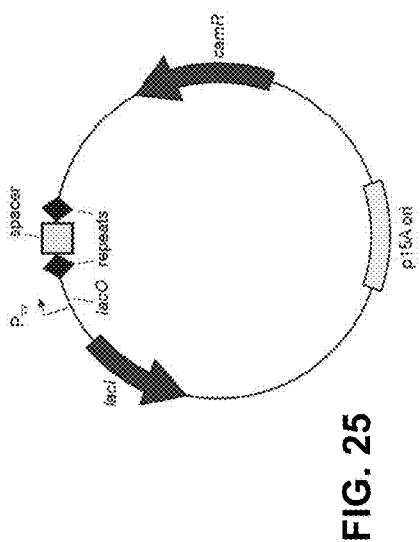

FIG. 25 contains a schematic diagram of an expression vector containing a CRISPR array with 2 repeats (FIG. 25, "repeats") and 1 spacer (FIG. 25, "spacer"). The array can be expanded, as described herein. The designations in FIG. 25 are described in this Example and in Example 1 and are as follows: $P_{T7}$ (T7 promoter), lacO (Lac operator), lacI (LacI repressor gene), p15A ori (origin of replication), and camR (chloramphenicol resistance gene).

Table 15 provides the sequences of bacterial expression plasmids encoding examples of minimal CRISPR arrays.

TABLE 15

Bacterial Plasmid Sequences

| SEQ ID NO: | Vector designation | DNA targeted by spacer | Notable characteristics |
|---|---|---|---|
| SEQ ID NO: 444 | CRISPR(J3) expression vector | Bacteriophage λ J3 target | Two repeats, one spacer |
| SEQ ID NO: 445 | CRISPR(L3) expression vector | Bacteriophage λ L3 target | Two repeats, one spacer |
| SEQ ID NO: 446 | CRISPR(J3/L3) expression vector | Bacteriophage λ L3/J3 targets | Three repeats, two spacers |
| SEQ ID NO: 447 | CRISPR(TRAC) expression vector | TRAC gene | Three repeats, two spacers |

Example 3

Design of Eukaryotic Expression Vectors for Production of Cascade Effector Complexes in Mammalian Cells This Example describes the design of eukaryotic expression plasmid vectors that encode Cascade-associated proteins, as well as minimal CRISPR arrays comprising the component sequences as described in Example 1.

A. Separate Plasmids Expressing Each Cascade Protein and Minimal CRISPR Array

Cascade proteins can be expressed in mammalian cells by encoding each of the protein components on a separate expression vector driven by the human cytomegalovirus (CMV) immediate-early promoter/enhancer and encoding the crRNA on a separate expression vector driven by the human U6 promoter.

The starting plasmid for each expression plasmid was a derivative of pcDNA3.1 (Thermo Scientific, Wilmington, Del.). Coding sequences for the Cascade proteins, codon optimized for expression in human cells (see Example 1), were inserted into the vector downstream of the CMV promoter and upstream of a bovine growth hormone (bGH) polyadenylation signal. The cse2 gene was fused to polynucleotide sequences at the 5' end coding for an N-terminal NLS and 3×-FLAG epitope tag. The cas5 gene was fused to polynucleotide sequences at the 5' end coding for an N-terminal NLS. The cas6 gene was fused to polynucleotide sequences at the 5' end coding for an N-terminal NLS and HA epitope tag. The cas7 gene was fused to polynucleotide sequences at the 5' end coding for an N-terminal NLS and Myc epitope tag. The cas8 gene was fused to polynucleotide sequences at the 5' end coding for an N-terminal NLS; in another embodiment, the cas8 gene was fused to polynucleotide sequences at the 5' end coding for an N-terminal NLS, HA epitope tag, and FolkI nuclease domain.

Each gene or gene fusion was cloned into a pcDNA3.1 derivative vector backbone, which confers ampicillin resistance due to the presence of the ampR gene. The vector also encodes neomycin resistance due to the presence of the neoR gene, which is downstream of an SV40 early promoter ($P_{SV40}$) and origin (SV40 ori), and upstream of an SV40 early polyadenylation signal (SV40 pA). In addition to the human CMV immediate-early promoter/enhancer ($P_{CMV}$) and bGH (bovine growth hormone) polyadenylation signal, the vector contains a T7 promoter upstream of the gene of interest, allowing for in vitro transcription of mRNA. The vector contains an f1 origin of replication as well as a ColE1 origin of replication.

Figure 26:
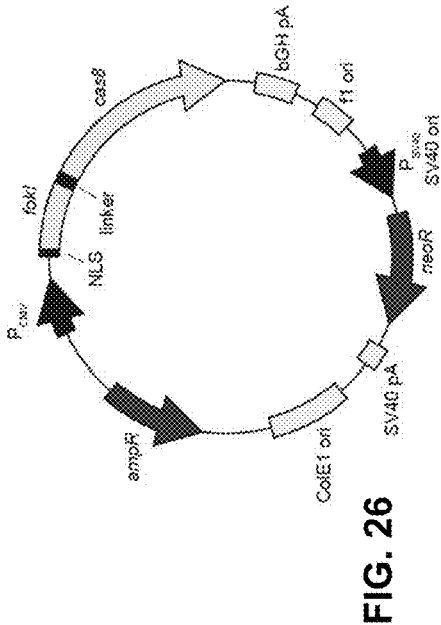

FIG. 26 contains a schematic diagram of a mammalian expression vector encoding the FokI-Cas8 fusion protein. The designations in FIG. 26 are described in this Example and in Example 1 and are as follows: the human CMV immediate-early promoter/enhancer ($P_{CMV}$), NLS (nuclear localization signal), FolkI (FolkI nuclease domain (Sharkey variant)), Cas8 protein coding sequence, bGH pA (bovine growth hormone polyadenylation signal), f1 ori (f1 phage origin of replication), $P_{SV40}$ (SV40 early promoter), SV40 ori (SV40 origin), neoR (neomycin resistance gene), SV40 pA (SV40 early polyadenylation signal), colE1 ori (origin of replication), and ampR (ampicillin resistance gene). Vectors encoding the other Cascade proteins were designed similarly.

Table 16 provides the sequences of individual mammalian expression vectors encoding each of Cse2, Cas5, Cas6, Cas7, Cas8, and FokI-Cas8.

TABLE 16

Mammalian Expression Vectors

| SEQ ID NO: | Vector designation | Notable characteristics |
|---|---|---|
| SEQ ID NO: 448 | Mammalian Cse2 expression vector | Cse2 contains N-terminal NLS-3xFLAG tag |
| SEQ ID NO: 449 | Mammalian Cas5 expression vector | Cas5 contains N-terminal NLS |
| SEQ ID NO: 450 | Mammalian Cas6 expression vector | Cas6 contains N-terminal NLS-Ha tag |
| SEQ ID NO: 451 | Mammalian Cas7 expression vector | Cas7 contains N-terminal NLS-Myc tag |
| SEQ ID NO: 452 | Mammalian Cas8 expression vector | Cas8 contains N-terminal NLS |
| SEQ ID NO: 453 | Mammalian FokI-Cas8 expression vector | Cas8 contains N-terminal NLS-HA-FokI; FokI confers the ability to cleave double-stranded DNA |

The CRISPR RNA was encoded with a minimal CRISPR array containing three repeats flanking two spacer sequences. The construct generating CRISPR RNA can be designed with additional sequences flanking the outermost repeats in the minimal array. Processing of the precursor CRISPR RNA is enabled by the RNA processing protein of the Cascade complex (Cas6 protein), which can be expressed on a separate plasmid.

The CRISPR array was cloned into the same pcDNA3.1 derivative vector backbone described above, except the human CMV promoter was replaced with the human U6 promoter ($P_{U6}$), and the bGH polyadenylation signal was replaced with a poly-T termination signal.

Figure 27:
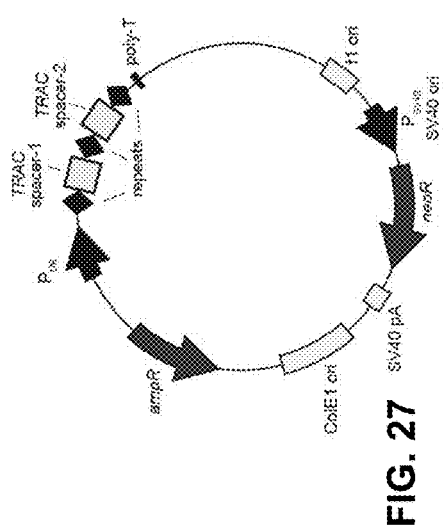

FIG. 27 contains a schematic diagram of a eukaryotic expression vector encoding a representative CRISPR array targeting the TRAC gene. The designations in FIG. 27 are described in this Example and in Example 1 and are as follows: $P_{U6}$ (human U6 promoter), repeats (CRISPR RNA repeats), TRAC spacer-1 (first spacer targeting the TRAC gene), TRAC spacer-2 (second spacer targeting the TRAC gene), polyT (poly-T termination signal), f1 ori (f1 phage origin of replication), $P_{SV40}$ (SV40 early promoter), SV40 ori (SV40 origin), neoR (neomycin resistance gene), SV40 pA (SV40 early polyadenylation signal), colE1 ori (origin of replication), and ampR (ampicillin resistance gene).

Table 17 provides the sequence of a representative mammalian expression vector encoding a CRISPR array targeting the TRAC gene; a spacer sequence that targets matching DNA sequences in the TRAC gene can be found in Table 13.

TABLE 17

Mammalian Expression Vector

| SEQ ID NO: | Vector designation | Spacer complementary to target | Notable characteristics |
| --- | --- | --- | --- |
| SEQ ID NO:454 | Mammalian CRISPR RNA expression vector | TRAC gene | Three repeats, two spacers |

B. Cascade Protein Expression System Wherein Multiple Cascade Protein Coding Sequences are Expressed from a Single Promoter In order to express components of the Cascade complex off of fewer expression vectors, polycistronic expression vectors were constructed. On each, a single CMV promoter drives expression of multiple coding sequences simultaneously that are separated by a 2A viral peptide sequence. The *Thosea asigna* virus 2A peptide sequence induces ribosomal skipping (Liu, Z., et al., Sci. Rep. 7:2193 (2017)), thus enabling multiple protein-coding genes to be concatenated within a single polycistronic construct.

The starting plasmid for the polycistronic expression plasmid was the same derivative of pcDNA3.1 described above, containing the CMV promoter and bGH polyadenylation signal. Coding sequences for the Cascade proteins, codon optimized for expression in human cells (see Example 1), were joined in the order cas7-cse2-cas5-cas6-cas8, with a polynucleotide sequence coding for the *Thosea asigna* virus 2A (T2A) peptide inserted in between each pair of genes. In addition, polynucleotide sequences encoding NLS tags were appended to the 5' end of each Cascade protein gene, and a polynucleotide sequence encoding the FokI nuclease domain was appended to the 5' end of the cas8 gene, connecting by a 30-amino acid linker sequence. The final construct has the following order of elements: NLS-cas7-T2A-NLS-cse2-T2A-NLS-cas5-T2A-NLS-cash-T2A-NLS-fokI-linker-cas8.

Figure 28:
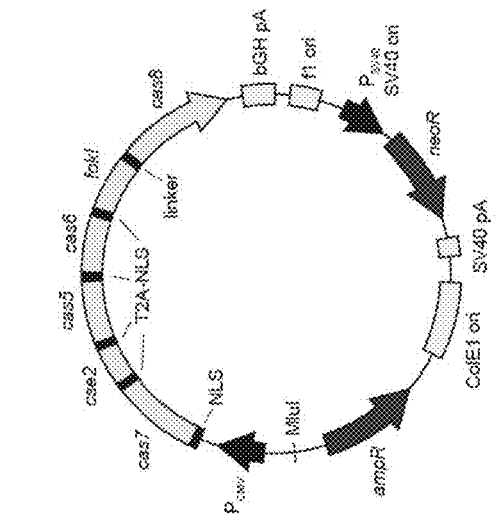

FIG. 28 contains a schematic diagram of an exemplary polycistronic mammalian expression vector encoding all the Cascade proteins. The designations in FIG. 28 are described in this Example and in Example 1 and are as follows: the human CMV immediate-early promoter/enhancer ($P_{CMV}$), NLS (nuclear localization signal), T2A (polynucleotide sequence coding for the *Thosea asigna* virus 2A peptide), coding sequences for the Cas7, Cse2, Cas5, and Cas6 proteins, fokI (FolkI nuclease domain (Sharkey variant) a linker sequence, coding sequence for Cas8 protein, bGH pA (bovine growth hormone polyadenylation signal), f1 ori (f1 phage origin of replication), $P_{SV40}$ (SV40 early promoter), SV40 ori (SV40 origin), neoR (neomycin resistance gene), SV40 pA (SV40 early polyadenylation signal), colE1 ori (origin of replication), ampR (ampicillin resistance gene), and an MluI restriction site.

Table 18 provides the sequence of an exemplary polycistronic mammalian expression vector encoding all the Cascade proteins. This vector can be combined with the mammalian expression vector encoding CRISPR RNA described above to produce functional Cascade complexes in mammalian cells.

TABLE 18

Mammalian Expression Vectors

| SEQ ID NO: | Vector designation | Arrangement of protein coding sequences (N to C) | Notable characteristics |
| --- | --- | --- | --- |
| SEQ ID NO: 455 | Polycistronic mammalian expression vector encoding all 5 Cascade proteins | NLS-Cas7-T2A_NLS-Cse2-T2A_NLS-Cas5-T2A_NLS-Cas6-T2A_NLS-FokI-Cas8 | Single protein expression vector encoding all Cascade proteins, each with N-terminal NLS tag. Cas8 contains N-terminal NLS-IIA-FokI; FokI confers the ability to cleave double-stranded DNA |

C. Single Plasmid Expression System

A single plasmid Cascade expression system was constructed to express the complete Cascade complex in human cells. The plasmid encodes the entire cas8-cse2-cas7-cas5-cas6 operon and a minimal CRISPR array on a single plasmid. This plasmid was constructed from the polycistronic protein expression vector (described above in Table 18 and FIG. 28) by inserting the minimal CRISPR array along with the upstream human U6 promoter and downstream poly-T termination signal into the MluI restriction site.

Table 19 provides the sequence of the single plasmid for expression of all five Cascade proteins together with the crRNA to facilitate formation of Cascade complexes in human cells.

TABLE 19

Mammalian Expression Vectors

| SEQ ID NO: | Vector designation | Arrangement of protein coding sequences (N to C) | Notable characteristics |
| --- | --- | --- | --- |
| SEQ ID NO: 456 | Polycistronic mammalian expression vector encoding all 5 Cascade proteins and crRNA | hU6_CRSPR (TRAC), CMV_NLS-Cas7-T2A_NLS-Cse2-T2A_NLS-Cas5-T2A_NLS-Cas6_NLS-FokI-Cas8 | Single protein expression vector encoding crRNA and all Cascade proteins, each with N-terminal NLS tag. Cas8 contains N-terminal NLS-HA-FokI; FokI confers the ability to cleave double-stranded DNA |

Plasmids were also designed for the expression of the Cas3 protein (SEQ ID NO:21; monomer Cas3 nuclease/helicase *E. coli* K-12 substr. MG1655) in *E. coli* and in mammalian cells. Table 20 provides the constructs and sequences of these plasmids.

TABLE 20

Cas3 Protein Fusions

| SEQ ID NO: | Protein | Notable characteristics |
| --- | --- | --- |
| SEQ ID NO: 457 | Cas3 | Genomic DNA gene sequence |
| SEQ ID NO: 458 | Cas3 | Protein amino acid sequence |
| SEQ ID NO: 459 | His6-MBP-TEV-Cas3 | Derived from genomic DNA gene sequence |
| SEQ ID NO: 460 | His6-MBP-TEV-Cas3 | Protein amino acid sequence |
| SEQ ID NO: 461 | His6-MBP-TEV-Cas3 | Cas3 *E. coli* expression vector |

TABLE 20-continued

Cas3 Protein Fusions

| SEQ ID NO: | Protein | Notable characteristics |
|---|---|---|
| SEQ ID NO: 462 | Cas3, human codon-optimized | *Homo sapiens* codon-optimized DNA gene sequence |
| SEQ ID NO: 463 | Cas3-NLS | *Homo sapiens* codon-optimized DNA gene sequence |
| SEQ ID NO: 464 | Cas3-NLS | Protein amino acid sequence |
| SEQ ID NO: 465 | Cas3-NLS | Cas3 mammalian expression vector |

Example 4

Introduction of Polynucleotides Encoding Cascade Components into a Bacterial Production Strain This Example describes for introduction and expression of Cas8 subunit protein coding sequences, as well as coding sequences for components of engineered Type I CRISPR-Cas effector complexes in bacterial cells using *E. coli* expression systems.

A. Expression of Cas8 Protein

*E. coli* Type I-E Cas8 protein was expressed from a plasmid (Example 2, SEQ ID NO:438, Table 14, FIG. 24A) containing an operon for the IPTG inducible expression of His6-MBP-TEV-Cas8 from a T7 promoter. The expression plasmid conferred resistance to kanamycin.

In order to express Cas8 protein, *E. coli* cells were transformed with the expression plasmid. Briefly, a 100 µL aliquot of chemically competent *E. coli* cells (*E. coli* BL21 Star™ cells (Thermofisher, Waltham, Mass.)) in a microcentrifuge tube was thawed on ice for 10 minutes. 35 ng of plasmid DNA was added to the thawed cells and the cells were incubated with the DNA on ice for 8 minutes. Heat shock was performed by a placing the microcentrifuge tube in a 42° C. water bath for 30 seconds and then immediately placing the tube in ice for 2 minutes. 900 µL of 2×YT media were added to the microcentrifuge tube, and the microcentrifuge tube was placed in a tube rotator at 37° C. for 1 hour. Finally, 100 µL of the recovered cells were plated on LB solid kanamycin (50 µg/mL) and incubated overnight at 37° C.

A single colony was picked from the colonies that grew on the antibiotic selection plates and was inoculated into 10 mL of 2×YT media supplemented with kanamycin (50 µg/mL). The culture was grown overnight at 37° C. while shaking in an orbital shaker at 200 RPMs. 6 mL of the overnight culture were transferred to a 2 L baffled flask having 1 L of 2×YT media supplemented with chloramphenicol (34 µg/mL) and spectinomycin (100 µg/mL). The 1 L culture was grown at 37° C. while shaking in an orbital shaker at 200 RPM until the optical density at 600 nm was 0.56.

Expression from both plasmids was then induced by the addition of IPTG to a final concentration of 1 mM. The induced cultures were grown overnight at 16° C. while shaking in an orbital shaker at 200 RPM. Cells were harvested by centrifugation at 4,000 RCF for 15 minutes at 4° C. The cell pellet was re-suspended in 15 mL of a lysis buffer composed of 50 mM Tris pH 7.5, 100 mM NaCl, 5% glycerol, and 1 mM TCEP supplemented with 1 Complete™ protease inhibitor tablet (Roche, Basel, Switzerland) per 50 mL of lysis buffer. The re-suspended cells were transferred to a 50 mL conical tube for immediate downstream processing. The Cas8 protein was purified and the purified protein characterized essentially as described below for the FokI-Cas8 fusion protein (Example 5C).

B. Expression of the Components of Cascade RNP Complexes

A complete set of the five *E. coli* Cascade proteins and RNA guides were co-expressed in *E. coli* cells using a two-plasmid system to produce Cascade RNP complexes. One plasmid (Example 2, SEQ ID NO:441, Table 14, FIG. 24D) contained an operon for IPTG inducible expression of the Cse2, Cas5, Cas6, Cas7, and Cas8 proteins from a T7 promoter. A His6 affinity tag was included as a translational fusion to the N-terminus of Cse2 (Example 1, SEQ ID NO:392, Table 11). The second plasmid coded for the IPTG inducible expression of the J3 guide (Example 2, SEQ ID NO:444, Table 15, FIG. 25). The Cascade protein expression plasmid conferred spectinomycin resistance, and the Cascade RNA guide expression plasmid conferred chloramphenicol resistance.

In order to co-express the Cascade proteins and RNA components in the same cell, *E. coli* cells were simultaneously transformed with the two plasmids. A 100 µL aliquot of chemically competent *E. coli* cells (*E. coli*, BL21 Star™ (DE3) (Thermofisher, Waltham, Mass.)) in a microcentrifuge tube was thawed on ice for 10 minutes. 35 ng of each plasmid was added to the thawed cells and the cells were incubated with the DNA on ice for 8 minutes. Heat shock was performed by a placing the microcentrifuge tube in a 42° C. water bath for 30 seconds and then immediately placing the microcentrifuge tube in ice for 2 minutes. 900 µL of 2×YT media were added to the microcentrifuge tube and the microcentrifuge tube placed in a tube rotator at 37° C. for 1 hour. Finally, 100 µL of the recovered cells were plated on LB solid media with chloramphenicol (34 µg/mL) and spectinomycin (50 µg/mL) and incubated overnight at 37° C.

A single colony was picked from the colonies that grew on the antibiotic selection plates and was inoculated into 10 mL of 2×YT media supplemented with chloramphenicol (34 µg/mL) and spectinomycin (100 µg/mL). The culture was grown overnight at 37° C. while shaking in an orbital shaker at 200 RPMs. 6 mL of the overnight culture were transferred to a 2 L baffled flask having 1 L of 2×YT media supplemented with chloramphenicol (34 µg/mL) and spectinomycin (100 µg/mL). The 0.1 L culture was grown at 37° C. while shaking in an orbital shaker at 200 RPM until the optical density at 600 nm was 0.56.

Expression from both plasmids was induced by the addition of IPTG to a final concentration of 1 mM. The induced cultures were grown overnight at 16° C. while shaking in an orbital shaker at 200 RPM. Cells were harvested by centrifugation for at 4,000 RCF for 15 minutes at 4° C. The cell pellet was re-suspended in 15 mL of lysis buffer composed of 50 mM Tris pH 7.5, 100 mM NaCl, 5% glycerol, and 1 mM TCEP supplemented with 1 Complete™ protease inhibitor tablet (Roche, Basel, Switzerland) per 50 mL of lysis buffer. The re-suspended cells were transferred to a 50 mL conical tube for immediate downstream processing. Cascade RNP complexes were purified and characterized as described below.

Example 5

Purification of Cascade Components and Cascade RNP Complexes

This Example describes a method to purify *E. coli* Type I-E Cascade ribonucleoprotein (RNP) complexes produced by overexpression in bacteria as described in Example 4.

The method uses immobilized metal affinity chromatography followed by size exclusion chromatography. This Example also describes the methods used to assess the quality of the purified Cascade RNP product. In addition, this Example describes purification and characterization of Cascade components.

A. Purification of Cas8, Cas7, Cas6, Cas5, and Cse2 Cascade RNP Complexes

E. coli Type I-E Cascade RNP complexes were produced as described in Example 4. The Cascade complexes were captured using immobilized metal affinity chromatography. Briefly, the re-suspended cell pellets, produced as described in Example 4, were thawed on ice and the volume was brought to 35 mL by of an additional 15 mL of lysis buffer composed of 50 mM Tris pH 7.5, 100 mM NaCl, 5% glycerol, and 1 mM TCEP supplemented with 1 Complete™ protease inhibitor tablet (Roche, Basel, Switzerland) per 50 mL of lysis buffer.

The 50 mL conical tube was placed in an ice water bath and the cells were lysed by two rounds of sonication using a Q500 sonicator with a ½ inch tip (Qsonica, Newtown, Conn.). Each round of sonication consisted of a treatment cycle of 2.5 minutes with repeating cycles of 10 seconds of sonication at 50% amplitude followed by 20 seconds of rest. The tube was allowed to cool in the ice water bath for one minute between rounds of sonication. The lysates were clarified by centrifugation at 48,384 RCF for 30 minutes at 4° C. The clarified supernatant was then added to a Hispur™ Ni-NTA resin (Thermofisher, Waltham, Mass.), that had been pre-equilibrated with Ni-wash buffer composed of 50 mM Tris pH 7.5, 100 mM NaCl, 10 mM imidazole, 5% glycerol, and 1 mM TCEP. A 1.5 mL bed volume of nickel affinity resin was used for each 1 L of E. coli expression culture. After one hour of incubation at 4° C. with gentle mixing, the resin was pelleted by centrifugation at 500 RCF for 2 minutes at 4° C. The supernatant was aspirated and the resin was washed 5 times with 5 bed volumes of Ni-wash buffer. After each wash the resin was pelleted at 500 RCF for 2 minutes at 4° C. and the supernatant was removed by aspiration. Finally, bound proteins (including the Cascade RNP complexes) were eluted by the addition of five bed volumes of Ni-elution buffer composed of 50 mM Tris pH 7.5, 100 mM NaCl, 300 mM imidazole, 5% glycerol, and 1 mM tris(2-carboxyethyl)phosphine (TCEP). After centrifugation at 500 RCF for 2 minutes at 4° C., the nickel affinity eluate was aspirated into a clean 50 mL conical tube.

The nickel affinity eluate was further purified by size exclusion chromatography (SEC). The nickel affinity eluate was concentrated to a final volume of 0.5 mL by ultrafiltration at 12° C. using an Amicon® ultrafiltration spin concentrator (Millipore Sigma, Billerica, Mass.) with an Ultracel®-50 membrane (Millipore Sigma, Billerica, Mass.). The concentrated sample was filtered using a 0.22 µM Ultrafree-MC GV Centrifugal Filter (Millipore Sigma, Billerica, Mass.) before being further purified by separation at 4° C. with a flow rate of 0.5 mL/minute on a HiPrep™ 16/60 Sephacryl® S-300 column (GE Healthcare, Uppsala, Sweden) equilibrated with SEC buffer composed of 50 mM Tris pH 7.5, 500 mM NaCl, 5% glycerol, 0.1 mM EDTA, and 1 mM TCEP. Proteins were eluted with SEC buffer and 1 ml fractions were collected. The earliest eluting peak, as judged by UV 280, was assumed to be high molecular weight aggregated material and the corresponding fractions were discarded. Subsequent elution fractions were analyzed by Coomassie stained SDS-PAGE. Each properly formed complex contained one molecule of Cas8, six molecules of Cas7, one molecule each of Cas6 and Cas5, and two molecules of Cse2. Elution fractions that had the approximate expected stoichiometry of Cascade proteins, when visualized on the SDS-PAGE gel, were pooled. Pooled fractions were analyzed spectrophotometrically to confirm they contained a significant nucleic acid component, as evidenced by an absorbance at 260 nm that is greater than the absorbance at 280 nm.

The pooled samples were exchanged into storage buffer composed of 50 mM Tris pH 7.5, 100 mM NaCl, 5% glycerol, 0.1 mM EDTA, and 1 mM TCEP by concentrating the pooled samples to 100 uL with an Amicon® spin concentrator with an Ultracel®-50 membrane (Millipore Sigma, Billerica, Mass.) and then diluting 50-fold with the storage buffer. Finally, the sample was concentrated to 10 mg/mL using the same ultrafiltration device and stored at −80° C.

The final purified product was analyzed spectrophotometrically to determine the final concentration of the Cascade RNP complexes and to confirm the presence of a nucleic acid component as evidenced by an absorbance at 260 nm that is greater than the absorbance at 280 nM. The concentration of the Cascade RNP complexes was determined by dividing the absorbance at 280 nm by the calculated absorbance of a 0.1% solution of the intact complex with a 1 cm path length. The predicted absorbance of a 0.1% solution of the purified complex is 2.03 $cm^{-1}$ and was calculated by dividing the sum of the calculated extinction coefficients at 280 nm for each of the molecules in the complex (916940 $M^{-1}$ $cm^{-1}$) by the sum of the molecular weights of each of the molecules in the complex (450832 g/mole).

Additionally, the final product was analyzed by SDS-PAGE with Coomassie blue staining to confirm that each protein component was present in approximately the correct stoichiometry, and to assess the presence of contaminating proteins. SDS-PAGE gels were stained with a Coomassie InstantBlue™ (Expedeon, San Diego, Calif.) stain. Gels were imaged using a Gel Doc™ EZ imager (Bio-Rad, Hercules, Calif.) and annotated using ImageLab software (Bio-Rad, Hercules, Calif.).

In view of the teachings of the Specification and the Examples, this method for purification of E. coli Type I-E Cascade complexes can be applied to the production of other purified Type I Cascade complexes.

B. Purification of Cascade Complexes Comprising Cas7, Cas6, Cas5, and Cse2 Proteins A Cascade complex composed of the and the protein components Cas7, Cas6, Cas5, and Cse2 was purified. The L3 guide RNA (Example 2, SEQ ID NO:445, Table 15) was expressed from a first plasmid (Example 2, FIG. 25) essentially as described in Example 4.B. The Cascade proteins were expressed from a second plasmid (Example 2, SEQ ID NO:440, Table 14, FIG. 24C) essentially as described in Example 4B.

The complex was captured using affinity chromatography. Re-suspended cell pellets were thawed on ice. In a 50 mL conical tube, the volume was brought up to 35 mL with an additional 15 mL of lysis buffer composed of 50 mM Tris pH 7.5, 100 mM NaCl, 5% glycerol, 1 mM TCEP, and supplemented with 1 Complete™ protease inhibitor tablet (Roche, Basel, Switzerland) per 50 mL of lysis buffer. The 50 mL conical tube was placed in an ice water bath, and the cells were lysed by six rounds of sonication using a Q500 sonicator with a ½ inch tip (Qsonica, Newtown, Conn.). Each round of sonication consisted of a 1 minute treatment cycle with repeating cycles of 3 seconds of sonication at 90% amplitude followed by 9 seconds of rest. The tube was allowed to cool in the ice water bath for one minute between rounds of sonication. The lysate was clarified by centrifugation at 48,384 RCF for 30 minutes at 4° C. The clarified supernatant was affinity purified by addition of Strep-Tactin® Sepharose® resin (IBA Life Sciences, Göttingen, Germany) that had been pre-equilibrated with Strep-wash buffer composed of 50 mM Tris pH 7.5, 100 mM NaCl, 1 mM EDTA, 5% glycerol, and 1 mM TCEP. A 0.55 mL bed volume of affinity resin was used for each 1 L of E. coli expression culture. After one hour of incubation at 4° C. with gentle mixing, the sample was poured onto a 30 mL disposable gravity flow column (Bio-Rad, Hercules, Calif.) allowing the unbound material to flow through the column. The resin was washed five times with five bed volumes of Strep-wash buffer. Finally, the bound proteins were eluted with two sequential additions of five bed volumes of Strep-elution buffer composed of 50 mM Tris pH 7.5, 100 mM NaCl, 2.5 mM Desthiobiotin, 5% glycerol, 1 mM EDTA, and 1 mM TCEP.

The affinity eluate was further purified by SEC. The affinity eluate was concentrated to a final volume of 550 uL by ultrafiltration at 12° C. using an Amicon® spin concentrator with an Ultracel®-50 membrane (Millipore Sigma, Billerica, Mass.). The concentrated sample was filtered using a 0.22 µm 13 mm UltraCruz® PVDF syringe filter (Santa Cruz Biotechnology, Dallas, Tex.) before being further purified by separation at 4° C. with a flow rate of 0.4 mL/minute on a HiPrep™ 16/60 Sephacryl® S-300 column (GE Healthcare, Uppsala, Sweden) equilibrated with SEC buffer composed of 50 mM Tris pH 7.5, 500 mM NaCl, 5% glycerol, 0.1 mM EDTA, and 1 mM TCEP. Protein was eluted with SEC buffer and 0.75 ml fractions were collected. The earliest eluting peak, as judged by UV 280, was assumed to be high molecular weight aggregated material and the corresponding fractions were discarded. Fractions corresponding to the second peak (a shoulder on the back side of the first UV 280 peak) were pooled.

The pooled samples were exchanged into storage buffer composed of 50 mM Tris pH 7.5, 100 mM NaCl, 5% glycerol, 0.1 mM EDTA, and 1 mM TCEP by concentrating down to 200 uL with an Amicon® spin concentrator with an Ultracel®-50 membrane (Millipore Sigma, Billerica, Mass.) and then diluting 75-fold with storage buffer. The sample was concentrated a second time to 700 uL and again diluted 20-fold with storage buffer. Finally, the sample was concentrated to 4.7 mg/mL in the same ultrafiltration device and stored at −80° C.

The final purified product was analyzed spectrophotometrically to determine the final concentration of the Cascade RNP complexes and to confirm the presence of a nucleic acid component as evidenced by an absorbance at 260 nm that is greater than the absorbance at 280 nM. The concentration of the Cascade RNP complexes was determined by dividing the absorbance at 280 nm by the calculated absorbance of a 0.1% solution of the intact complex with a 1 cm path length. The predicted absorbance of a 0.1% solution of the purified complex is 2.18 $cm^{-1}$ and was calculated by dividing the sum of the calculated extinction coefficients at 280 nm for each molecule in the complex (762240 $M\ cm^{-1}$) by the sum of the molecular weights of each molecule in the complex (348952.07 g/mole).

Additionally, the final product was analyzed by SDS-PAGE with Coomassie blue staining to confirm that each Cascade protein was present in approximately the correct stoichiometry, and to assess the presence of contaminating proteins. SDS-PAGE gels were stained with Coomassie InstantBlue™ (Expedeon, San Diego, Calif.) stain. Gels were imaged using a Gel Doc™ EZ imager (Bio-Rad, Hercules, Calif.) and annotated using ImageLab software (Bio-Rad, Hercules, Calif.). Each properly formed complex contained six molecules of Cas7, one molecule each of Cas6 and Cas5, and two molecules of Cse2.

C. Purification of FokI-Cas8 Fusion Protein

A method used to purify a fusion protein comprising a FokI nuclease fusion to the E. coli Type I-E Cas8 protein from bacterial over-expression pellets using immobilized metal affinity chromatography, cation exchange chromatography (CIEX), and finally size exclusion chromatography (SEC) is described herein.

The E. coli Type I-E FokI-Cas8 fusion protein, including a linker sequence, is described in Example 1 (SEQ ID NO:413, Table 11). The expression plasmid is described in Example 2 (SEQ ID NO:439, Table 14, FIG. 24B). Cells comprising the fusion protein were produced essentially as described in Example 4A. The Cas8 fusion protein contained a N-terminal His6 tag, a Maltose binding protein domain, a TEV cleavage site, a FokI nuclease domain, and a 30 amino acid linker. The protein was captured using immobilized metal affinity chromatography. A 50 mL conical tube containing the re-suspended cell pellets was thawed on ice. The tube was then placed in an ice water bath, and the cells were lysed by sonication using a Q500 sonicator with a ¼ inch tip (Qsonica, Newtown, Conn.) for a treatment cycle of three minutes with repeating cycles of 10 seconds of sonication at 40% amplitude followed by 20 seconds of rest. The lysates were clarified by centrifugation at 30,970 RCF for 30 minutes at 4° C. The clarified supernatant was then added to Hispur™ Ni-NTA resin (Thermofisher, Waltham, Mass.), that had been pre-equilibrated with Ni-wash buffer composed of 50 mM Tris pH 7.5, 100 mM NaCl, 10 mM imidazole, 5% glycerol, and 1 mM TCEP. A 2 mL bed volume of nickel affinity resin was used for 1 L of E. coli expression culture. After one hour of incubation at 4° C. with gentle mixing, the sample was poured onto a 30 mL disposable gravity flow column (Bio-Rad, Hercules, Calif.), allowing the unbound material to flow through the column. The resin was washed five times with five bed volumes of Ni-wash buffer. Finally, the bound proteins were eluted with five bed volumes of Ni-elution buffer composed of 50 mM Tris pH 7.5, 100 mM NaCl, 300 mM imidazole, 5% glycerol, and 1 mM TCEP.

The nickel affinity eluate was treated with TEV protease to remove the affinity tag. TEV protease was added to the eluate at a ratio of 1:25 (w/w). The sample, including TEV, was dialyzed overnight against Ni-wash buffer using a 12 mL Slid-A-Lyzer™, 10K MWCO dialysis cassette (Thermofisher, Waltham, Mass.).

The TEV protease and the cleaved His6-MBP fragment were removed from the dialyzed sample by Ni affinity chromatography. The dialyzed sample was poured over a clean Hispur™ Ni-NTA resin (Thermofisher, Waltham, Mass.) column equilibrated with Ni-wash buffer. The resin was then washed with 1 column volume of Ni-NTA wash buffer. The flow through and wash were combined, concentrated, and exchanged into storage buffer (50 mM Tris pH 7.5, 500 mM NaCl, 5% glycerol, and 1 mM TCEP) using an Amicon® spin concentrator with an Ultracel®-10 membrane (Millipore Sigma, Billerica, Mass.). This sample was then frozen at −80C for storage.

The sample was thawed and further purified by cation exchange chromatography (CIEX). The sample was thawed on ice and diluted 10-fold from 0.475 mL to 4.75 mL with Cold CIEX_A buffer composed of 50 mM Tris pH 7.5, 5% glycerol, and 1 mM TCEP, resulting in a final concentration of 50 mM NaCl. A 10 mL capillary loop was used to load the sample onto a 1 mL Hitrap™ SP HP column (GE Healthcare, Uppsala, Sweden), equilibrated with a buffer comprising CIEX_A buffer and 5% CIEX_B buffer (50 mM Tris pH 7.5, 1 M NaCl, 5% glycerol, and 1 mM TCEP). The flow rate throughout the separation was of 0.75 mL/min. The loop was emptied onto the column with 15 mL of with 5% CIEX_B buffer. The unbound sample was washed out with an additional 2 mL of 5% CIEX_B buffer. 500 µL fractions were collected as the bound proteins were eluted with an 8 mL linear gradient from 5% to 65% CIEX_B buffer. There were two major UV280 elution peaks. The four fractions corresponding to the first of those two peaks were pooled. The total pooled volume was 2 mL.

The pooled CIEX fractions were further purified by SEC. The pooled CIEX fractions were concentrated to a final volume of 0.3 mL by ultrafiltration at 12° C. using an Amicon® spin concentrator with an Ultracel®-10 membrane (Millipore Sigma, Billerica, Mass.). The concentrated sample was filtered using a 0.22 µm Ultrafree-MC GV Centrifugal spin filter (Millipore Sigma, Billerica, Mass.), and further purified by separation at 4° C. with a flow rate of 0.6 mL/minute on a 10/300 Superdex™ 200 GL Increase column (GE Healthcare, Uppsala, Sweden) equilibrated with a Cas8 SEC buffer (50 mM Tris pH 7.5, 200 mM NaCl, 5% glycerol, and 1 mM TCEP). The protein was eluted with the Cas8 SEC buffer and 0.5 ml fractions were collected. The earliest eluting peak, as judged by UV 280, was assumed to be high molecular weight aggregated material and the corresponding fractions were discarded. A second major UV 280 peak was eluted after about 14 mL. The fractions corresponding to this second peak were pooled. The pooled samples were concentrated to 40 µL with an Amicon® spin concentrator with an Ultracel®-3 membrane (Millipore Sigma, Billerica, Mass.) The concentrated sample was stored at −80° C.

The final purified product was analyzed spectrophotometrically to determine the final concentration of the fusion protein and to confirm the absence of a significant nucleic acid component as evidenced by an absorbance at 280 nm that is greater than the absorbance at 260 nm. The concentration of the FokI-Cas8 fusion was determined by dividing the absorbance at 280 nm by the calculated absorbance of a 0.1% solution of the intact complex. The predicted absorbance of a 0.1% solution of the purified complex is 1.05 $cm^{-1}$ and was calculated by dividing extinction coefficient at 280 nm for the FokI-Cas8 fusion (86290$M^{-1}$ $cm^{-1}$) by its molecular weight (82171.32 g/mole). Additionally, the final product was analyzed by SDS-PAGE gels stained with InstantBlue™ stain (Expedeon, San Diego, Calif.). Gels were imaged using a Gel Doc™ EZ imager (Bio-Rad, Hercules, Calif.) and annotated using ImageLab software (Bio-Rad, Hercules, Calif.). This analysis demonstrates that the purified fusion protein was the expected size and that only a low level of contaminating proteins were present.

Example 6

Production of Double-Stranded DNA (dsDNA) Target Sequences for Use in Biochemical Cleavage Assays Double-stranded DNA (dsDNA) target sequences for use in in vitro DNA binding or cleavage assays with Cascade or Cascade-fusion effector complexes can be produced using several different methods. This Example describes three methods to produce target sequences, including annealing of synthetic single-stranded DNA (ssDNA) oligonucleotides, PCR amplification of selected nucleic acid target sequences from genomic DNA, and/or cloning of nucleic acid target sequences into bacterial plasmids. The dsDNA target sequences were used in Cascade binding or cleavage assays.

A. Production of dsDNA Target Sequences by Annealing Synthetic Single-Stranded DNA Oligonucleotides DNA oligonucleotides encoding the target region of interest comprising the target sequence, also known as the protospacer, that is recognized by the guide portion of CRISPR RNA, the neighboring protospacer adjacent motif (PAM), and additional 5' and 3' flanking sequences were purchased from a commercial manufacturer (Integrated DNA Technologies, Coralville, Iowa). Two oligonucleotides were ordered per construct, one comprising the sense strand and one comprising the nonsense strand. Table 21 lists oligonucleotide sequences that were ordered to contain a target sequence denoted J3, which is derived from bacteriophage lambda genomic DNA. The target and PAM sequences are flanked by 20-bp of additional sequence on both the 5' and 3' ends.

TABLE 21

| Single-stranded DNA Oligonucleotides | | |
|---|---|---|
| Seq ID NO: | Description | Sequence |
| SEQ ID NO: 466 | Foward oligo, J3 target sequence | ATCATCCTCCTGACAATTTTGACAGCCCACATGGC ATTCCACTTATCACTGGCATCTTTAAAAGCCAGGA CGGTC |
| SEQ ID NO: 467 | Reverse oligo, J3 target sequence | GACCGTCCTGGCTTTTAAAGATGCCAGTGATAAGT GGAATGCCATGTGGGCTGTCAAAATTGTCAGGAG GATGAT |

The oligonucleotides were annealed by mixing both oligonucleotides at equimolar concentration (10 µM) in 1× annealing buffer (6 mM HEPES, pH 7.0, and 60 mM KCl), heating at 95° C. for 2 minutes, and then slow cooling. Annealed oligonucleotides were then used directly in DNA binding and/or DNA cleavage assays with Cascade and/or Cascade-effector domain fusion RNPs.

5' Cy5 fluorescently-labeled DNA oligonucleotides encoding the target region of interest comprising both the target sequence, also known as the protospacer, recognized by the guide portion of CRISPR RNA, as well as the flanking neighboring protospacer adjacent motif (PAM), and additional 5' and 3' flanking sequences, were purchased from a commercial manufacturer (Integrated DNA Technologies, Coralville, Iowa). Four oligonucleotides were ordered per construct, one comprising the 5' fluorescent-labeled sense strand, one comprising the 5' unlabeled sense strand, one comprising the 5' fluorescent-labeled nonsense strand, and one comprising the 5'unlabeled nonsense strand. The target and PAM sequences are flanked by 20-bp of additional sequence on both the 5' and 3' ends.

Table 22 lists oligonucleotide sequences that were ordered to contain a target sequence denoted J3, which was derived from bacteriophage lambda genomic DNA and a control target sequence denoted CCR5, which was derived from the human CCR5 locus.

TABLE 22

Single-stranded DNA (ssDNA) Oligonucleotides for Fluorescently Labeled dsDNA Target Sequence Formation

| SEQ ID NO: | Description | Sequence |
| --- | --- | --- |
| SEQ ID NO: 468 | target strand J3 | 5'CGCCGAGCTCGAATTCTTTTGACAGCCCACATGGCATTCCACTTATCACTGGCATGGATCCTGGCTGTGGTGATG |
| SEQ ID NO: 469 | non target strand J3 | 5'CATCACCACAGCCAGGATCCATGCCAGTGATAAGTGGAATGCCATGTGGGCTGTCAAAAGAATTCGAGCTCGGCG |
| SEQ ID NO: 470 | target strand CCR5 Site | 5'CGCCGAGCTCGAATTCTTTTTAGGTACCTGGCTGTCGTCCATGCTGTGTTTGCATGGATCCTGGCTGTGGTGATG |
| SEQ ID NO: 471 | non target strand CCR5 | 5'CATCACCACAGCCAGGATCCATGCAAACACAGCATGGACGACAGCCAGGTACCTAAAAAGAATTCGAGCTCGGCG |
| SEQ ID NO: 472 | target strand J3 | 5'Cy5-CGCCGAGCTCGAATTCTTTTGACAGCCCACATGGCATTCCACTTATCACTGGCATGGATCCTGGCTGTGGTGATG |
| SEQ ID NO: 473 | non target strand J3 | 5'Cy5-CATCACCACAGCCAGGATCCATGCCAGTGATAAGTGGAATGCCATGTGGGCTGTCAAAAGAATTCGAGCTCGGCG |
| SEQ ID NO: 474 | target strand CCR5 Site | 5'Cy5-CGCCGAGCTCGAATTCTTTTTAGGTACCTGGCTGTCGTCCATGCTGTGTTTGCATGGATCCTGGCTGTGGTGATG |

The oligonucleotides were annealed by mixing a labeled and unlabeled or two labeled or two unlabeled oligonucleotides at equimolar concentration (1 μM) in 1× annealing buffer (6 mMHEPES, pH 7.0, 60 mM KCl), heating at 95° C. for 2 minutes, and then slow cooling. Annealed oligonucleotides were then used directly in DNA binding assays with Cascade and/or Cascade-effector domain fusion RNPs. Cy5 fluorescently-labeled DNA oligonucleotides were imaged with an AZURE c600 Bioimager (Azure BioSystems, Dublin, Calif.).

This method can be applied to produce additional labeled or unlabeled target or dual-target sequences, whereby a dual target is defined as a target that contains two protospacer sequences targeted by individual Cascade molecules, separated by an interspacer sequence.

B. Production of dsDNA Target Sequences by PCR Amplification from Genomic DNA

Double-stranded DNA target sequences for dual targets derived from human genomic DNA were produced using PCR amplification directly from genomic DNA template material. Specifically, PCR reactions contained human genomic DNA purified from K562 cells and Q5 Hot Start High-Fidelity 2× Master Mix (New England Biolabs, Ipswich, Mass.), as well as the primers listed in Table 23, where the underlined portions correspond to primer binding sites within genomic DNA.

TABLE 23

Primers for PCR Amplification

| Seq ID NO: | Description | Sequence |
| --- | --- | --- |
| SEQ ID NO: 475 | Forward primer to amplify Hsa07 dual-target from human genomic DNA | CACTCTTTCCCTACACGACGCTCTTCCGAT<u>CTTTCCTCCCTAACCTCCACCT</u> |
| SEQ ID NO: 476 | Reverse primer to amplify Hsa07 dual-target from human genomic DNA | GGAGTTCAGACGTGTGCTCTTCCGATCTTA<u>AAGAGCCCAACCAGATGC</u> |

PCR was performed according to the manufacturer's instructions (New England Biolabs, Ipswich, Mass.), and the desired product DNA, 288-bp in length, was purified using a Nucleospin Gel and PCR Cleanup kit (Macherey-Nagel, Bethlehem, Pa.) This dsDNA was then used directly in DNA binding and/or DNA cleavage assays with Cascade and/or Cascade-effector domain fusion RNPs.

C. Production of dsDNA Target Sequences by Cloning Target Sequences into Bacterial Plasmids DNA oligonucleotides encoding the target region of interest comprising the target sequence, also known as the protospacer, that is recognized by the guide portion of CRISPR RNA, the neighboring protospacer adjacent motif (PAM), and additional 5' and 3' flanking sequences were purchased from a commercial manufacturer (Integrated DNA Technologies, Coralville, Iowa). The oligonucleotides were designed such that, when annealed, the termini regenerate sticky ends upon cleavage of their respective recognition sites by the restriction enzymes EcoRI and BlpI, or by BamHI and EcoRI. Oligonucleotides were designed to contain a single target sequence derived from the bacteriophage lambda genome, denoted J3. In addition, oligonucleotides were designed to contain two tandem target sequences derived from the bacteriophage lambda genome, denoted J3 and L3, separated from each other by a 15-bp interspacer sequence. Sequences of these oligonucleotides are listed in Table 24.

TABLE 24

Oligonucleotides Comprising Target Sequences

| Seq ID NO: | Description | Restriction enzyme recognition sites | Sequence |
| --- | --- | --- | --- |
| SEQ ID NO: 477 | Forward oligonucleotide J3 target sequence for cloning into pACYC-Duet1 | BamHI and EcoRI | GATCCATGCCAGTGATAAGTG GAATGCCATGTGGGCTGTCAA AAG |
| SEQ ID NO: 478 | Reverse oligonucleotide, J3 target sequence for cloning into pACYC-Duet1 | BamHI and EcoRI | AATTCTTTTGACAGCCCACATG GCATTCCACTTATCACTGGCAT G |
| SEQ ID NO: 479 | Foward oligonucicotidc, J3-15bp-L3 target sequences for cloning into pACYC-Duet1 | EcoRI and BlpI | AATTCTTTTGACAGCCCACATG GCATTCCACTTATCACTGGCAT CCTAGGCCTCTCGAGATGAGTG GCAGATATAGCCTGGTGGTTCA GGCGGCGCATGC |
| SEQ ID NO: 480 | Reverse oligonucleotide, J3-15bp-L3 target sequences for cloning into pACYC-Duet1 | EcoRI and BlpI | TCAGCATGCGCCGCCTGAACCA CCAGGCTATATCTGCCACTCAT CTCGAGAGGCCTAGGATGCCA GTGATAAGTGGAATGCCATGT GGGCTGTCAAAAG |

The oligonucleotides contain 5'-phosphorylated ends, which were introduced by the commercial manufacturer or phosphorylated in-house using T4 polynucleotide kinase (New England Biolabs, Ipswich, Mass.). The oligonucleotides were then annealed at a final concentration of 1 µM by mixing together equimolar amounts in annealing buffer (6 mM HEPES, pH 7.0, 60 mM KCl), heating to 95° C. for 2 minutes, and then slow-cooling on the benchtop.

Separately, a pACYC-Duet1 (MilliporeSigma, Hayward, Calif.) plasmid was double-digested with the corresponding pair of restriction enzymes, either BamHI and EcoRI, or EcoRI and BlpI, whose sticky ends match the sticky ends formed by the termini of the hybridized oligonucleotides. The double-digested vector was separated from the removed insert using agarose gel electrophoresis.

In order to clone the hybridized oligonucleotides into the double-digested vector, the hybridized oligonucleotides were diluted to a 50 nM stock concentration, and then a 10 µL ligation reaction was formed using hybridized oligonucleotides, the double-digested vector, and Quick Ligase from New England Biolabs. The ligation reaction was then used to transform chemically competent E. coli strains, and after overnight growth on agarose plates, individual clones were isolated and grown in liquid culture to generate sufficient bacterial cultures from which to isolate plasmids. Sanger sequencing was then used to validate the desired plasmid sequence. Table 25 provides complete vector sequences for plasmids containing the J3 target sequence (SEQ ID NO:481) and plasmids containing the J3 and L3 targets sequences separated by the 15-bp interspacer sequence (SEQ ID NO:482).

TABLE 25

Complete Plasmid Sequences

| SEQ ID NO: | Description of plasmid |
| --- | --- |
| SEQ ID NO: 481 | J3 target sequence in pACYC-Duet1 |
| SEQ ID NO: 482 | J3-15bp-L3 target sequences in pACYC-Duet1 |
| SEQ ID NO: 483 | J3-30bp-L3 target sequences in pACYC-Duet1 |
| SEQ ID NO: 484 | multi-target plasmid |

Further cloning manipulations were used to generate additional double-target plasmid constructs. The 15-bp interspacer sequence of SEQ ID NO:482 contains unique AvrII and XhoI restriction sites. Thus, introduction of additional hybridized oligonucleotides into these restriction sites expands the interspacer to longer lengths, for biochemical testing with purified Cascade and Cascade-nuclease fusion RNPs. Because the crRNA-guided FokI-Cascade fusion complex targets two adjacent DNA site, dimerization of the FolkI domains from adjacent DNA-bound complexes leads to DNA cleavage within the interspacer separating the two target sites. Variable interspacer lengths were designed and tested to evaluate a given interspacer length with a given tethering geometry between the FolkI nuclease domain and its fused Cascade subunit protein. The complete vector sequence for a target DNA substrate containing an expanded interspacer sequence of 30-bp in length is given in Table 25 as SEQ ID NO:483.

In addition, the following cloning strategy provided a plasmid substrate that contains several target sequences serially connected along one large insert. A gene block was ordered from a commercial manufacturer (Integrated DNA Technologies, Coralville, Iowa) that contained 17 consecutive dual targets. The gene block contained 4 bp separating each dual target from a neighboring dual target, and contained 16 dual targets derived from *Homo sapiens* genomic DNA, as well as one control dual target containing J3/L3 targets derived from the bacteriophage lambda genome. The genomic coordinates of the 16 consecutive human dual targets are shown in Table 26. The gene block was ordered with flanking SacI and SbfI restriction sites on the ends, such that it could be cloned into SacI and SbfI sites in the pACYC-Duet1 vector. The full vector sequence of the multi-target plasmid substrate generated by cloning the gene block into pACYC-Duet1 is presented as SEQ ID NO:484 in Table 25. This multi-target sequence plasmid allowed for biochemical testing of multiple different FokI-Cascade preparations harboring crRNAs targeting one of the serially connected target sites within the plasmid.

TABLE 26

Human Dual Targets

| SEQ ID NO: | Target name | Gene | 5' spacer target genomic coordinates | 3' spacer target genomic coordinates |
|---|---|---|---|---|
| SEQ ID NO: 485 | Hsa01 | PDCD1 | chr2:241850348-241850382 | chr2:241850408-241850442 |
| SEQ ID NO: 486 | Hsa02 | CTLA4 | chr2:203870664-203870698 | chr2:203870724-203870758 |
| SEQ ID NO: 487 | Hsa03 | TRAC | chr14:22509340-22509374 | chr14:22509405-22509439 |
| SEQ ID NO: 488 | Hsa04 | TRAC | chr14:22509785-22509819 | chr14:22509850-22509884 |
| SEQ ID NO: 489 | Hsa05 | TRAC | chr14:22513932-22513966 | chr14:22513997-22514031 |
| SEQ ID NO: 490 | Hsa06 | TRAC | chr14:22515993-22516027 | chr14:22516058-22516092 |
| SEQ ID NO: 491 | Hsa07 | TRAC | chr14:22516265-22516299 | chr14:22516330-22516364 |
| SEQ ID NO: 492 | Hsa08 | CD52 | chr1:26320402-26320436 | chr1:26320467-26320501 |
| SEQ ID NO: 493 | Hsa09 | CTLA4 | chr2:203873012-203873046 | chr2:203873077-203873111 |
| SEQ ID NO: 494 | Hsa10 | CTLA4 | chr2:203873195-203873229 | chr2:203873260-203873294 |
| SEQ ID NO: 495 | Hsa11 | TRAC | chr14:22551630-22551664 | chr14:22551700-22551734 |
| SEQ ID NO: 496 | Hsa12 | CTLA4 | chr2:203872758-203872792 | chr2:203872828-203872862 |
| SEQ ID NO: 497 | Hsa13 | TRAC | chr14:22551862-22551896 | chr14:22551937-22551971 |
| SEQ ID NO: 498 | Hsa14 | TRBC2 | chr7:142801112-142801146 | chr7:142801187-142801221 |
| SEQ ID NO: 499 | Hsa15 | TRAC | chr14:22551630-22551664 | chr14:22551710-22551744 |
| SEQ ID NO: 500 | Hsa16 | CTLA4 | chr2:203867814-203867848 | chr2:203867894-203867928 |

Example 7

Use of Purified Cascade Complexes in Biochemical Cleavage Assays

This Example illustrates the use of FokI-Cascade fusion protein complexes in biochemical double-stranded DNA (dsDNA) cleavage assays. Protein reagents were compared in terms of their activity in dsDNA cleavage.

FokI-Cascade RNPs derived from the *E. coli* Type I-E Cascade system were designed, recombinantly expressed in *E. coli*, and purified for use, as outlined in Examples 1, 2, and 5. These RNPs were designed to contain either CRISPR RNAs that target the J3 and L3 target sequences derived from bacteriophage lambda genomic DNA, or that target an intron in the TRAC gene within human genomic DNA. Each RNP preparation is a heterogeneous mixture comprising two FokI-Cascade complexes that are otherwise identical except for the guide portion of the crRNA.

A FokI-Cascade complex was reconstituted by mixing together a CasBCDE complex (produced using SEQ ID NO:440 and SEQ ID NO:446, as described in Example 2) with purified FokI-Cas8 comprising a 16-aa linker (the general FokI-Cas8 expression vector sequence is described in Example 2, SEQ ID NO:439 in Table 14; the particular 16-aa linker is in Example 1, SEQ ID NO:431 in Table 12). Reconstitution was performed in 1× Cascade Cleavage Buffer (20 mM Tris-Cl, pH 7.5, 200 mM NaCl, 5 mM $MgCl_2$, 1 mM TCEP, 5% glycerol) with CasBCDE and FokI-Cas8 both at 1 µM final concentrations.

In order to perform DNA cleavage assays, reaction mixtures were as follows. A plasmid substrate comprising the J3/L3 double-target sequence with a 30-bp interspacer (SEQ ID NO:483 in Table 25) was incubated with varying concentrations of FokI-Cascade complex (3-100 nM) in a 15 µL reaction in 1× Cascade Cleavage Buffer, with the plasmid DNA at a final concentration of 13.3 ng/µL. Reactions were incubated for 30 minutes at 37° C., after which 3 µL of 6×SDS loading dye was added. The loading dye was added to denature bound FokI-Cascade complexes. The reaction mixture components were resolved by 0.8% agarose gel electrophoresis. Gels were stained after electrophoresis with SYBR™ Safe DNA Gel Stain (Thermo Scientific, Wilmington, Del.).

As a positive control, *Streptococcus pyogenes* Cas9 protein was programmed with a single-guide RNA (sgRNA) targeting a 20-bp portion of the Cascade J3 target sequence (sgRNA-J3; the spacer sequence is presented as SEQ ID NO:501). Cas9/sgRNA-J3 complexes were reconstituted by mixing Cas9 together with a 2-fold molar excess of sgRNA in 1×CCE buffer (20 mM HEPES pH 7.4, 10 mM $MgCl_2$, 150 mM KCl, 5% glycerol). Cleavage by this Cas9/sgRNA-J3 complex was evaluated across the same concentration range (3-100 nM) by incubating reactions for 30 minutes at 37° C. Also included in the experiment were control lanes containing uncut plasmid DNA, as well as plasmid DNA linearized with the NheI restriction enzyme (New England Biolabs, Ipswich, Mass.). Target DNA cleavage is evidenced by a mobility shift in the plasmid, because uncut plasmid DNA is supercoiled and has a faster mobility than cleaved, linearized plasmid DNA: Nicked, open-circular plasmid DNA has a slower mobility than both supercoiled and linearized plasmid DNA.

The data obtained from these experiments demonstrate that, over the concentration range, the FokI-Cascade complex exhibited similar target DNA cleavage activity as Cas9-sgRNA. At the highest concentration tested (100 nM), the plasmid target was quantitatively linearized by the FokI-Cascade complex and Cas9-sgRNA.

FokI-Cascade complex reagents were also tested for their kinetics of target DNA cleavage. A plasmid substrate containing the J3/L3 double-target sequence with a 30-bp interspacer (SEQ ID NO:483) was incubated with 200 nM FokI-Cascade complex or 200 nM Cas9-sgRNA in a 15 µL reaction, with the plasmid DNA at a final concentration of 13.3 ng/4. Reactions were quenched at either 0, 7, 10, 15, 20, 25, or 30 minutes, and reaction components were resolved by agarose gel electrophoresis as described above. The FokI-Cascade complex exhibited similar but slightly slower rates of target DNA cleavage activity as Cas9/sgRNA-J3 complex, with the target plasmid quantitatively linearized by the 25 minute time-point for the FokI-Cascade complex and by the 20 minute time point for the Cas9/sgRNA-J3 complex.

FokI-Cascade complex reagents were also tested for their non-specific DNA cleavage and/or nicking activity on the pACYC-Duet1 non-target plasmid substrate, versus specific DNA cleavage of a the J3/L3 double-target plasmid substrate. Table 27 contains the sequence of the pACYC-Duet1 non-target plasmid substrate used for this control (SEQ ID NO:502). Specifically, the dependence of non-specific and specific DNA target cleavage was investigated as a function of the monovalent salt concentration in the reaction buffer. Modified variants of the 1× Cascade Cleavage Buffer (20 mM Tris-Cl, pH 7.5, 200 mM NaCl, 5 mM $MgCl_2$, 1 mM TCEP, and 5% glycerol) were prepared, in which the NaCl concentration was dropped from 200 mM to either 150 mM, 100 mM or 50 mM, and the same cleavage reactions as described above were performed by incubating 200 nM FokI-Cascade complex with either 13.3 ng/4 of the J3/L3 target plasmid or 13.3 ng/μL of the pACYC-Duet1 non-target plasmid. Additional control reactions were performed, in which the NaCl concentration was maintained at 100 mM, but the 5 mM MgCl2 was replaced with 10 mM EDTA, which was expected to abrogate cleavage because of the requirement of FokI for divalent metal ions for DNA cleavage. Accordingly, non-target plasmid and J3/L3 target plasmid were subjected to the following reaction conditions: −FokI-Cascade complex; +FokI-Cascade complex, 100 mM NaCl buffer+10 mM EDTA; +FokI-Cascade complex, 50 mM NaCl buffer; +FokI-Cascade complex, 100 mM NaCl buffer; +FokI-Cascade complex, 150 mM NaCl buffer; +FolkI-Cascade complex, 200 mM NaCl buffer. The data demonstrate that FokI-Cascade complex showed non-specific nicking of both the non-target and J3/L3 target plasmid at low salt concentrations <200 mM NaCl, but that at a monovalent salt concentration of 200 mM NaCl, the non-target plasmid remained intact, but the J3/L3 target plasmid was quantitatively linearized. Furthermore, buffer containing EDTA led to a complete abrogation of target cleavage, as expected.

In order to confirm that the FokI-Cascade complex cleaves the target plasmid at the expected position, that is, within the middle of the interspacer sequence separating the J3 and L3 targets, an experiment was performed in which the target plasmid was first incubated with FokI-Cascade complex, followed by incubation with the AfeI restriction enzyme (New England Biolabs, Ipswich, Mass.), which cleaves elsewhere in the plasmid substrate. Thus, cleavage by both FolkI-Cascade 1 complex and AfeI converts the supercoiled, circular plasmid into two linear fragments migrating as distinct species on an agarose gel. Specifically, cleavage was expected to generate fragments that are 2427 bp and 1357 bp in length.

13.3 ng/μL J3/L3 target plasmid was incubated with 200 nM FolkI-Cascade 1 complex for 30 minutes, after which 1 μL of AfeI (10 Units/μL; New England Biolabs, Ipswich, Mass.) was added to the reaction, followed by an additional 30-minute incubation at 37° C. Reaction products were resolved by agarose gel electrophoresis, as described above. Additionally, for control experiments, the target plasmid was incubated with only FolkI-Cascade 1 complex or only AfeI, and the same reactions were performed with a non-target plasmid that can be cleaved by AfeI but not by FokI-Cascade 1 complex (because the plasmid lacks the J3/L3 dual target). Table 27 contains the sequence of the pACYC-Duet1 non-target plasmid substrate used for this control (SEQ ID NO:502). Accordingly, non-target plasmid and J3/L3 target plasmid were subjected to the following reaction conditions: −AfeI/−FokI-Cascade complex; −AfeI/+FokI-Cascade complex; +AfeI/+FokI-Cascade complex; and +AfeI/−FokI-Cascade complex. The data demonstrate that FolkI-Cascade complex cleaved the target plasmid in the expected location, because co-incubation with FokI-Cascade 1 complex and AfeI lead to two linear products of the expected lengths.

In order to further confirm the sequence specificity of DNA cleavage by the FokI-Cascade complex, additional control plasmid substrates were generated that contain as follows: mutations in the PAM flanking the J3 target, mutations in the PAM flanking the L3 target, mutations in both PAMs flanking J3/L3 targets; mutations in the spacer sequence within the J3 target, mutations in the spacer sequence within the L3 target, mutations in both spacer sequences within J3/L3 targets; and the J3 target but not the L3 target, the L3 target but not the J3 target, and neither J3 nor L3 target. Accordingly, the plasmid substrates were as follows: J3 PAM mutant, L3 PAM mutant, J3/L3 PAM mutant, J3 spacer mutant, L3 spacer mutant, J3/L3 spacer mutant, non-target plasmid, J3-only target, L3-only target, and J3/L3 target plasmid. Each target was subjected to the following reaction conditions: −NdeI/−FokI-Cascade complex; +NdeI/−FokI-Cascade complex; and −NdeI/+FokI-Cascade 1 complex. Table 27 contains the sequences of all the mutated plasmid substrates described above (SEQ ID NO:502 through SEQ ID NO:510).

TABLE 27

Mutated Plasmid Substrate Sequences

| SEQ ID NO: | Description of plasmid |
| --- | --- |
| SEQ ID NO:502 | pACYC-Duet1 non-target plasmid |
| SEQ ID NO:503 | J3-30bp-L3 target plasmid, J3 PAM mutant |
| SEQ ID NO:504 | J3-30bp-L3 target plasmid, L3 PAM mutant |
| SEQ ID NO:505 | J3-30bp-L3 target plasmid, J3/L3 PAM mutants |
| SEQ ID NO:506 | J3-30bp-L3 target plasmid, J3 spacer mutant |
| SEQ ID NO:507 | J3-30bp-L3 target plasmid, L3 spacer mutant |
| SEQ ID NO:508 | J3-30bp-L3 target plasmid, J3/L3 spacer mutants |
| SEQ ID NO:509 | J3-only target plasmid |
| SEQ ID NO:510 | L3-only target plasmid |

DNA cleavage reactions were performed as described above, using 200 nM FokI-Cascade complex and 13.3 ng/μL plasmid substrates; control reactions to linearize each plasmid substrate were performed with NdeI (New England Biolabs, Ipswich, Mass.). Agarose gel electrophoresis was performed as described above. The data demonstrate that efficient double-strand beak introduction and linearization of the target plasmid is only observed for the J3/L3 target plasmids, but not for control plasmids harboring PAM or seed mutations, or only one of the two target sites.

Components for various FolkI-Cascade complexes were cloned and overexpressed. RNPs produced by these components were purified and tested for biochemical DNA cleavage, in order to compare activity for different FolkI-Cascade complexes. Specifically, DNA cleavage activities were compared for reconstituted FolkI-Cascade complexes comprising the following: separately purified CasBCDE complex (produced using SEQ ID NO:440 and SEQ ID NO:446) and FolkI-Cas8 (produced using SEQ ID NO:439); FokI-Cascade harboring the J3/L3 guide crRNAs (produced using SEQ ID NO:442 and SEQ ID NO:446); FolkI-Cascade harboring an additional nuclear localization signal on either the Cas7 subunit (produced using SEQ ID NO:443 and SEQ ID NO:446) or the Cas6 subunit; FokI-Cascade harboring an additional nuclear localization signal and HA tag on either the Cas7 subunit or the Cas6 subunit; FolkI-Cascade that underwent a more stringent purification involving both size exclusion chromatography (SEC) and ion exchange chromatography (IEX); and FolkI Cascade that was purified only by immobilized metal affinity chromatography (IMAC), without further clean-up.

Accordingly, non-target plasmid and J3/L3 target plasmid were subjected to the following reaction conditions: negative control; AfeI; CasBCDE+FokI-Cas8 complex; FolkI-Cascade complex; FolkI-Cascade (NLS-Cas6) complex; FolkI-Cascade (Cas7-NLS) complex; FolkI-Cascade (NLS-HA-Cas6) complex; FolkI-Cascade (Cas7-HA-NLS) complex; FokI-Cascade complex (IEX, SEC clean-up); and FolkI-Cascade complex (no clean-up). DNA cleavage reactions were performed with these RNP reagents as described above, using either the non-target plasmid or the consensus J3/L3 target plasmids, and reaction products were resolved by agarose gel electrophoresis. The data demonstrate that all of the RNP reagents, with one exception, exhibit nearly identical and quantitative plasmid DNA cleavage, with no background cleavage of the non-target plasmid. The sole exception was the FolkI-Cascade purified without further clean-up, which exhibited more non-specific nicking activity, as seen for the lane in which it was incubated with the non-target plasmid.

Finally, using the NLS-tagged Cas7 variant of the FokI-Cascade complex as a starting point, 16 different paired guide crRNA were tested for biochemical DNA cleavage of a plasmid substrate for *Homo sapiens* genomic sites Hsa01 through Hsa16 serially connected along one large insert (SEQ ID NO:484). Each pair of crRNAs contains two unique spacer sequences that correspond to two adjacent target sites in human genomic DNA, separated by an interspacer; the target sequences are described in SEQ ID NO:485 through SEQ ID NO:500. Table 28 contains sequences of both crRNAs within each pair that targets Hsa01 through Hsa16 genomic DNA sequences; the spacer of the crRNA is underlined and in lower case, and the sequences 5' and 3' of the guide region correspond to repeat sequences from the CRISPR array.

TABLE 28 crRNA Sequences

| SEQ ID NO: | DNA target | crRNA sequence |
|---|---|---|
| SEQ ID NO:511 | Hsa01-1 | AUAAACCGcgggcaggcagagcuggaggccuuucaggccc GAGUUCCCCGCGCCAGCGGGG |
| SEQ ID NO:512 | Hsa01-2 | AUAAACCGggccugaggugcugccugggcauguguaaagg GAGUUCCCCGCGCCAGCGGGG |
| SEQ ID NO:513 | Hsa02-1 | AUAAACCGcacugucacccggaccucaguggcuuugccug GAGUUCCCCGCGCCAGCGGGG |
| SEQ ID NO:514 | Hsa02-2 | AUAAACCGucugugcggcaaccuacaugauggggaaugag GAGUUCCCCGCGCCAGCGGGG |
| SEQ ID NO:515 | Hsa03-1 | AUAAACCGaugagcuuguuuguagcaccaccauaauucac GAGUUCCCCGCGCCAGCGGGG |
| SEQ ID NO:516 | Hsa03-2 | AUAAACCGuacguaaguaguggcaugugucagguggauuc GAGUUCCCCGCGCCAGCGGGG |
| SEQ ID NO:517 | Hsa04-1 | AUAAACCGaaggcauuuggaccggcagacacauaauugua GAGUUCCCCGCGCCAGCGGGG |
| SEQ ID NO:518 | Hsa04-2 | AUAAACCGagacuccagagccauccuugggaagagugcug GAGUUCCCCGCGCCAGCGGGG |
| SEQ ID NO:519 | Hsa05-1 | AUAAACCGacaagaggugguguuuccugaauucccacagug GAGUUCCCCGCGCCAGCGGGG |
| SEQ ID NO:520 | Hsa05-2 | AUAAACCGuaaguguuucuagccauccuugauuuugauca GAGUUCCCCGCGCCAGCGGGG |

TABLE 28-continued crRNA Sequences

| SEQ ID NO: | DNA target | crRNA sequence |
|---|---|---|
| SEQ ID NO:521 | Hsa06-1 | AUAAACCGuggcuacugcucugucuccugggauccugccu GAGUUCCCCGCGCCAGCGGGG |
| SEQ ID NO:522 | Hsa06-2 | AUAAACCGgcccauaccuucaaggaaaauuaaggcaaaua GAGUUCCCCGCGCCAGCGGGG |
| SEQ ID NO:523 | Hsa07-1 | AUAAACCGguugauuugccugcauuggguguuacacagucu GAGUUCCCCGCGCCAGCGGGG |
| SEQ ID NO:524 | Hsa07-2 | AUAAACCGuaaguuuguuucuucuuugccuaggccuucag GAGUUCCCCGCGCCAGCGGGG |
| SEQ ID NO:525 | Hsa08-1 | AUAAACCGgcacugccugucaacuucuacaaccuggugau GAGUUCCCCGCGCCAGCGGGG |
| SEQ ID NO:526 | Hsa08-2 | AUAAACCGuaggggccaagcagugcccagcugggggucaa GAGUUCCCCGCGCCAGCGGGG |
| SEQ ID NO:527 | Hsa09-1 | AUAAACCGcuuucacugaaaguggagcugaugugacagaa GAGUUCCCCGCGCCAGCGGGG |
| SEQ ID NO:528 | Hsa09-2 | AUAAACCGaugugggucaaggaauuaaguuagggaauggc GAGUUCCCCGCGCCAGCGGGG |
| SEQ ID NO:529 | Hsa10-1 | AUAAACCGgcauaaaauuuaacuugaaaagaucauuucgg GAGUUCCCCGCGCCAGCGGGG |
| SEQ ID NO:530 | Hsa10-2 | AUAAACCGgcuuucaaaaauacucacauggcuauguuuuag GAGUUCCCCGCGCCAGCGGGG |
| SEQ ID NO:531 | Hsa11-1 | AUAAACCGaggggcaaugcagaggaaggagcgagggagca GAGUUCCCCGCGCCAGCGGGG |
| SEQ ID NO:532 | Hsa11-2 | AUAAACCGgaggugaaagcugcuaccaccucugugccccc GAGUUCCCCGCGCCAGCGGGG |
| SEQ ID NO:533 | Hsa12-1 | AUAAACCGgcugaaauugcuuuucacauucuggcucuguu GAGUUCCCCGCGCCAGCGGGG |
| SEQ ID NO:534 | Hsa12-2 | AUAAACCGagaguccauauuucaauuuccaagagcugagg GAGUUCCCCGCGCCAGCGGGG |
| SEQ ID NO:535 | Hsa13-1 | AUAAACCGugcacagccagggaggcugcagcagccuugc GAGUUCCCCGCGCCAGCGGGG |
| SEQ ID NO:536 | Hsa13-2 | AUAAACCGauggaucuucaguggguucucuuugggcucuag GAGUUCCCCGCGCCAGCGGGG |
| SEQ ID NO:537 | Hsa14-1 | AUAAACCGccuguggccaggcacaccagugUGGCCUU UUGGAGUUCCCCGCGCCAGCGGGG |
| SEQ ID NO:538 | Hsa14-2 | AUAAACCGgaggugcacagugggggucagcacagacccgca GAGUUCCCCGCGCCAGCGGGG |
| SEQ ID NO:539 | Hsa15-1 | AUAAACCGaggggcaaugcagaggaaggagcgagggagca GAGUUCCCCGCGCCAGCGGGG |
| SEQ ID NO:540 | Hsa15-2 | AUAAACCGcugcuaccaccucugugccccccccggcaaugc GAGUUCCCCGCGCCAGCGGGG |
| SEQ ID NO:541 | Hsa16-1 | AUAAACCGgacuuuauauagauagcuuugaucccagauau GAGUUCCCCGCGCCAGCGGGG |
| SEQ ID NO:542 | Hsa16-2 | AUAAACCGguuuugcucuacuuccugaagaccugaacacc GAGUUCCCCGCGCCAGCGGGG |

After the 16 FolkI-Cascade complexes were purified, cleavage reactions were performed as described above, wherein the FolkI-Cascade complexes were incubated with the plasmid substrate containing *Homo sapiens* genomic sites Hsa01 through Hsa16, and the reaction products were resolved by agarose gel electrophoresis. The data demonstrate that, of the 16 RNP reagents, 14/16 (Hsa03-Hsa16) exhibited nearly quantitative DNA cleavage, as evidenced by conversion of the supercoiled, circular plasmid substrate into the cleaved, linear form. Only constructs Hsa01 and Hsa02 showed partial nicking activity.

Example 8

Introduction of FolkI-Cascade RNP Complexes into Target Cells

This Example illustrates the design and delivery of *E. coli* Type I-E Cascade complexes comprising FolkI fusion proteins to facilitate genome editing in human cells and describes their delivery into target cells as pre-assembled Cascade RNP complexes.

A. Production of Cascade RNP Complexes Comprising FokI for Transformation into Cells Minimal CRISPR arrays were designed to target eight distinct loci in the human genome. Each minimal CRISPR array contained two spacer sequences, both of which were flanked by CRISPR repeat sequences. The two spacer sequences targeted loci in the genome separated by 30 bp (i.e., a 30-bp interspacer region), and each spacer was designed to bind a target sequence adjacent to an AAG or ATG protospacer adjacent motif (PAM) sequence in the target cell genome. Plasmid vectors containing each minimal CRISPR array were produced by ligating annealed oligonucleotides (Integrated DNA Technologies, Coralville, Iowa) into a pACYC-Duet1 (Millipore Sigma, Billerica, Mass.) vector backbone for bacterial expression.

Overlapping primers to produce selected spacers in minimal CRISPR arrays are set forth in Table 29, and the sequences of the primers are described in Table 30.

TABLE 29

Overlapping Primers for Generation of Minimal CRISPR arrays

| Component | Gene target | Primers |
|---|---|---|
| Hsa03 Minimal CRISPR array | TRAC intron | A,B |
| Hsa04 Minimal CRISPR array | TRAC intron | C,D |
| Hsa05 Minimal CRISPR array | TRAC intron | E,F |
| Hsa06 Minimal CRISPR array | TRAC intron | G,H |
| Hsa07 Minimal CRISPR array | TRAC intron | I,J |
| Hsa08 Minimal CRISPR array | CD52 exon | K,L |
| Hsa09 Minimal CRISPR array | CTLA4 exon | M,N |
| Hsa10 Minimal CRISPR array | CTLA exon | O,P |

TABLE 30

DNA Primer Sequences

| SEQ ID NO: | Oligo-nucleotide | Sequence |
|---|---|---|
| SEQ ID NO:543 | A | /5Phos/ACCGATGAGCTTGTTTGTAGCACCACCATAATTC ACGAGTTCCCCGCGCCAGCGGGGATAAACCGTACGTA AGTAGTGGCATGTGTCAGGTGGATTC |
| SEQ ID NO:544 | B | /5Phos/ACTCGAATCCACCTGACACATGCCACTACTTACG TACGGTTTATCCCCGCTGGCGCGGGGAACTCGTGAATT ATGGTGGTGCTACAAACAAGCTCAT |
| SEQ ID NO:545 | C | /5Phos/ACCGAAGGCATTTGGACCGGCAGACACATAATT GTAGAGTTCCCCGCGCCAGCGGGGATAAACCGAGACT CCAGAGCCATCCTTGGGAAGAGTGCTG |
| SEQ ID NO:546 | D | /5Phos/ACTCAGCACTCTTCCCAAGGATGGCTCTGGAGT CTCGGTTTATCCCCGCTGGCGCGGGGAACTCTACAATT ATGTGTCTGCCGGTCCAAATGCCTT |
| SEQ ID NO:547 | E | /5Phos/ACCGACAAGAGGTGTGTTTCCTGAATTCCCACA GTGGAGTTCCCCGCGCCAGCGGGGATAAACCGTAAGT GTTTCTAGCCATCCTTGATTTTGATCA |
| SEQ ID NO:548 | F | /5Phos/ACTCTGATCAAAATCAAGGATGGCTAGAAACAC TTACGGTTTATCCCCGCTGGCGCGGGGAACTCCACTGT GGGAATTCAGGAAACACACCTCTTGT |
| SEQ ID NO:549 | G | /5Phos/ACCGTGGCTACTGCTCTGTCTCCTGGGATCCTGC CTGAGTTCCCCGCGCCAGCGGGGATAAACCGGCCCAT ACCTTCAAGGAAAATTAAGGCAAATA |
| SEQ ID NO:550 | H | /5Phos/ACTCTATTTGCCTTAATTTTCCTTGAAGGTATGG GCCGGTTTATCCCCGCTGGCGCGGGGAACTCAGGCAG GATCCCAGGAGACAGAGCAGTAGCCA |
| SEQ ID NO:551 | I | /5Phos/ACCGGTTGATTTGCCTGCATTGGTGTTACACAGT CTGAGTTCCCCGCGCCAGCGGGGATAAACCGTAAGTTG TGTTCTTCTTTGCCTAGGCCTTCAG |
| SEQ ID NO:552 | J | /5Phos/ACTCCTGAAGGCCTAGGCAAAGAAGAACACAAC TTACGGTTTATCCCCGCTGGCGCGGGGAACTCAGACTG TGTAACACCAATGCAGGCAAATCAAC |
| SEQ ID NO:553 | K | /5Phos/ACCGGCACTGCCTGTCAACTTCTACAACCTGGTG ATGAGTTCCCCGCGCCAGCGGGGATAAACCGTAGGGG CCAAGCAGTGCCCAGCTGGGGGTCAA |
| SEQ ID NO:554 | L | /5Phos/ACTCTTGACCCCCAGCTGGGCACTGCTTGGCCCC TACGGTTTATCCCCGCTGGCGCGGGGAACTCATCACCA GGTTGTAGAAGTTGACAGGCAGTGC |
| SEQ ID NO:555 | M | /5Phos/ACCGCTTTCACTGAAAGTGGAGCTGATGTGACA GAAGAGTTCCCCGCGCCAGCGGGGATAAACCGATGTG GGTCAAGGAATTAAGTTAGGGAATGGC |
| SEQ ID NO:556 | N | /5Phos/ACTCGCCATTCCCTAACTTAATTCCTTGACCCAC ATCGGTTTATCCCCGCTGGCGCGGGGAACTCTTCTGTC ACATCAGCTCCACTTTCAGTGAAAG |
| SEQ ID NO:557 | O | /5Phos/ACCGGCATAAAATTTAACTTGAAAAGATCATTT CGGGAGTTCCCCGCGCCAGCGGGGATAAACCGGCTTC AAAAATACTCACATGGCTATGTTTTAG |
| SEQ ID NO:558 | P | /5Phos/ACTCCTAAAACATAGCCATGTGAGTATTTTTGAA GCCGGTTTATCCCCGCTGGCGCGGGGAACTCCCGAAAT GATCTTTTCAAGTTAAATTTATGC |
| SEQ ID NO:559 | Q | CACTCTTTCCCTACACGACGCTCTTCCGATCTAGCCTGG AAAGACACAAAGC |
| SEQ ID NO:560 | R | GGAGTTCAGACGTGTGCTCTTCCGATCTCAGCCATCCT TTCCACCTAA |
| SEQ ID NO:561 | S | CACTCTTTCCCTACACGACGCTCTTCCGATCTATGCTGC AGGCTTTATGCTT |
| SEQ ID NO:562 | T | GGAGTTCAGACGTGTGCTCTTCCGATCTTTAGGCCTGC CTGACTTCTC |

TABLE 30-continued

DNA Primer Sequences

| SEQ ID NO: | Oligo-nucleotide | Sequence |
|---|---|---|
| SEQ ID NO:563 | U | CACTCTTTCCCTACACGACGCTCTTCCGATCTGGGAAG AAGACCAACAAGAGG |
| SEQ ID NO:564 | V | GGAGTTCAGACGTGTGCTCTTCCGATCTTTCAAGGGAA GAAGCCATTG |
| SEQ ID NO:565 | W | CACTCTTTCCCTACACGACGCTCTTCCGATCTAAGGCA GGAATTGGATGAAA |
| SEQ ID NO:566 | X | GGAGTTCAGACGTGTGCTCTTCCGATCTAACCTGAGAT GACTGCCCAT |
| SEQ ID NO:567 | Y | CACTCTTTCCCTACACGACGCTCTTCCGATCTTTCCTCC CTAACCTCCACCT |
| SEQ ID NO:568 | Z | GGAGTTCAGACGTGTGCTCTTCCGATCTTAAAGAGCCC AACCAGATGC |
| SEQ ID NO:569 | A2 | CACTCTTTCCCTACACGACGCTCTTCCGATCTGTCTCAG CCTTAGCCCTGTG |
| SEQ ID NO:570 | B2 | GGAGTTCAGACGTGTGCTCTTCCGATCTCCCACTGCAA GTACAAGGGT |
| SEQ ID NO:571 | C2 | CACTCTTTCCCTACACGACGCTCTTCCGATCTGGATGC GGAACCCAAATTA |
| SEQ ID NO:572 | D2 | GGAGTTCAGACGTGTGCTCTTCCGATCTTAGTCTTCTCC CTCGCTCCC |
| SEQ ID NO:573 | E2 | CACTCTTTCCCTACACGACGCTCTTCCGATCTTGCAGCA TTATGATGTGGGT |
| SEQ ID NO:574 | F2 | GGAGTTCAGACGTGTGCTCTTCCGATCTCAACCTTTAG CATCACTGGCT |
| SEQ ID NO:575 | G2 | CAAGCAGAAGACGGCATACGAGATNNNNNNNNG TGACTGGAGTTCAGACGTGTGCTC |
| SEQ ID NO:576 | H2 | AATGATACGGCGACCACCGAGATCTACACNNNNN NNNACACTCTTTCCCTACACGACG |

The design of bacterial expression vectors for production of Cascade RNP complexes is detailed in Example 2. In brief, each cas gene was expressed from a single operon, and the coding sequences for the cas genes were arranged in the order of cas8-cse2-cas7-cas5-cas6. The FokI moiety was attached by a 30-aa linker to Cas8, and a nuclear localization signal (NLS) was attached to the N-terminus of FokI-Cas8 (FokI-Cascade complex) and the N-terminus of Cas6 (hereafter referred to as FokI-Cascade-NLS-Cas6 complex, SEQ ID NO:577).

FokI-Cascade-NLS-Cas6 complexes were purified as assembled complexes from E. coli essentially as described in Example 5A.

B. Transfection of Cascade RNP Complexes Comprising FokI into Eukaryotic Cells

HEK293 cells (ATCC, Manassas, Va.) were cultured in suspension in DMEM medium supplemented with 10% FBS and 1× Antibiotic-Antimycotic Solution (Mediatech, Inc., Manassas, Va.) at 37° C., 5% $CO_2$ and 100% humidity. HEK293 cells were transfected using the Nucleofector® 96-well Shuttle System (Lonza, Allendale, N.J.). Prior to nucleofection, 5 μl of FokI-Cascade RNPs were transferred to individual wells of a 96-well plate. Each well contained ~225-500 pmol of FokI-Cascade-NLS-Cas6 complexes, depending on the RNP. HEK293 cells were transferred to a 50 ml conical centrifuge tube and centrifuged at 200×G for 3 minutes. The media was aspirated and the cell pellet was washed in calcium and magnesium-free PBS. The cells were centrifuged once more and re-suspended in Nucleofector SF buffer (Lonza, Allendale, N.J.) at a concentration of $1×10^7$ cells/ml. 20 μl of this cell suspension was added to the FokI-Cascade-NLS-Cas6 complexes in the 96-well plate, mixed, and then the entire volume was transferred to a 96-well Nucleocuvette™ Plate. The plate was then loaded into the Nucleofector™ 96-well Shuttle™ and cells were nucleofected using the 96-CM-130 Nucleofector™ program (Lonza, Allendale, N.J.). Immediately following nucleofection, 80 μl of complete DMEM medium was added to each well of the 96-well Nucleocuvette™ Plate. The entire contents of the well were then transferred to a 96-well tissue culture plate containing 100 μl of complete DMEM medium. The cells were cultured at 37° C., 5% $CO_2$ and 100% humidity for ~72 hours.

After ~72 hours, the HEK293 cells were centrifuged at 500×G for 5 minutes and the medium was removed. The cells were washed in calcium and magnesium-free PBS. The cell pellets were then re-suspended in 50 μl of QuickExtract DNA Extraction solutions (Epicentre, Madison, Wis.). The gDNA samples obtained were then incubated at 37° C. for 10 minutes, 65° C. for 6 minutes, and 95° C. for 3 minutes to stop the reaction. gDNA samples were then diluted with 50 μl of water and stored at −20° C. for subsequent deep sequencing analysis.

C. Deep Sequencing of gDNA from Transfected Cells

Using the isolated gDNA, a first PCR was performed using Q5 Hot Start High-Fidelity 2× Master Mix (New England Biolabs, Ipswich, Mass.) at 1× concentration, primers at 0.5 μM each, 3.75 μL of gDNA in a final volume of 10 μL and amplified 98° C. for 1 minutes, 35 cycles of 10 seconds at 98° C., 20 seconds at 60° C., 30 seconds at 72° C., and a final extension at 72° C. for 2 minutes. PCR reaction was diluted 1:100 in water. Target-specific primers are shown in Table 31. The target-specific primers contained Illumina-compatible sequences so that the amplification products could be analyzed using a MiSeq Sequencer (Illumina, San Diego).

TABLE 31

Target-specific Primers Used for Sequencing

| Target | Oligonucleotide* |
| --- | --- |
| Hsa03 on-target | Q,R |
| Hsa04 on-target | S,T |
| Hsa05 on-target | U,V |
| Hsa06 on-target | W,X |
| Hsa07 on-target | Y,Z |
| Hsa08 on-target | A2,B2 |
| Hsa09 on-target | C2,D2 |
| Hsa10 on-target | E2,F2 |

*DNA primer sequences are shown in Table 30

A second "barcoding" PCR was set up such that each target was amplified with primers (G2 and H2 in Table 30) that each contained unique 8 bp indices (denoted by "NNNNNNNN" in the primer sequence (see SEQ ID NO:575 and SEQ ID NO:576), thus allowing de-multiplexing of each amplicon during sequence analysis.

The second PCR was performed using Q5 Hot Start High-Fidelity 2× Master Mix (New England Biolabs, Ipswich, Mass.) at 1× concentration, primers at 0.5 µM each, 1 µL of 1:100 diluted first PCR, in a final volume of 10 µL and amplified 98° C. for 1 minute, 12 cycles of 10 seconds at 98° C., 20 seconds at 60° C., 30 seconds at 72° C., and a final extension at 72° C. for 2 minutes. PCR reactions were pooled into a single microfuge tube for SPRIselect bead (Beckman Coulter, Pasadena, Calif.)-based cleanup of amplicons for sequencing.

To pooled amplicons, 0.9× volumes of SPRIselect beads were added, mixed and incubated at room temperature for 10 minutes. The microfuge tube was placed on a magnetic tube stand (Beckman Coulter, Pasadena, Calif.) until solution had cleared. Supernatant was removed and discarded, and the residual beads were washed with 1 volume of 85% ethanol, and incubated at room temperature (RT) for 30 seconds. After incubation, ethanol was aspirated and beads were air dried at room temperature for 10 minutes. The microfuge tube was then removed from the magnetic stand and 0.25× volumes of water (Qiagen, Hilden, Germany) was added to the beads, mixed vigorously, and incubated for 2 min. at RT. The microfuge tube was spun in a microcentrifuge to collect the contents of the tube, and was then returned to the magnet, incubated until solution had cleared, and the supernatant containing the purified amplicons were dispensed into a clean microfuge tube. The purified amplicon library was quantified using the Nanodrop™ 2000 system (Thermo Scientific, Wilmington, Del.).

The amplicon library was normalized to 4 nM concentration as calculated from optical absorbance at 260 nm (Nanodrop™ 2000 system; Thermo Scientific, Wilmington, Del.) and size of the amplicons. Library was analyzed on MiSeq Sequencer with MiSeq Reagent Kit v2, 300 cycles (Illumina, San Diego), with two 151-cycle paired-end run plus two eight-cycle index reads.

D. Deep Sequencing Data Analysis

The identity of products in the sequencing data was analyzed based upon the index barcode sequences adapted onto the amplicons in the second round of PCR. A computational script executing the following tasks was used to process the MiSeq data:

Reads were aligned to the human genome (build GRCh38/38) using Bowtie (bowtie-bio.sourceforge.net/index.shtml) software.

Aligned reads were compared to wild-type loci; reads not aligning to any part of the loci were discarded.

Reads matching wild-type sequence were tallied. Reads with indels (surrounding 10 bp from the FokI-Cascade RNP putative cut site) were categorized by indel type and tallied.

Total indel reads were divided by the sum of wild-type reads and indel reads to give percent-mutated reads.

Figure 29:

FIG. 29 shows genome editing as a function of FokI-Cascade-NLS-Cas6 complex nucleofection (n=1). FokI-Cascade-NLS-Cas6 complexes induced editing at all eight loci. Editing ranged from ~0.2-5% indels, and indels were centered around the predicted cut site, in the middle of the interspacer region.

Example 9

Introduction of Plasmids Encoding Components of FokI-Cascade RNP Complexes into Target Cells This Example illustrates the design and delivery of E. coli Type I-E Cascade complexes comprising FokI fusion proteins to facilitate genome editing in human cells. This Example also describes the delivery of plasmid vectors expressing Cascade complex components into eukaryotic cells.

A. Production of a Vector Encoding FokI-Cascade RNP Components to be Transfected into Target Cells A minimal CRISPR array was designed to target the TRAC locus in the human genome. The minimal CRISPR array contained two spacer sequences, both of which were flanked by CRISPR repeat sequences, as described in Examples 1 and 3. The two spacer sequences targeted loci in the genome separated by 30 bp and each spacer was complementary to a genomic sequence adjacent to an AAG PAM sequence. The plasmid vector containing the minimal CRISPR array was produced by ligating annealed oligonucleotides (Integrated DNA Technologies, Coralville, Iowa) encoding a CRISPR repeat flanked by two spacer sequences into a mammalian expression vector with two CRISPR repeat sequences. The resulting plasmid contained a "repeat-spacer-repeat-spacer-repeat" dual guide expressed from the human U6 (hU6) promoter (SEQ ID No:454).

FokI-Cascade RNP protein component-encoding genes were cloned into plasmid vectors containing CMV promoters to enable delivery and expression in mammalian cells. Cas genes were cloned into separate plasmids (SEQ ID NO:448 through SEQ ID NO:451 and SEQ ID NO:453) or in a single plasmid as a polycistronic construct with each gene linked via 2A viral peptide "ribosome-skipping" sequences (in SEQ ID NO:455). FokI-Cascade RNP complexes were delivered into eukaryotic cells via two different methods: cas genes and the minimal CRISPR array were supplied on separate plasmids ("six plasmid"-delivery system, SEQ ID NO:448 through SEQ ID NO:451, SEQ ID NO:453 and SEQ ID NO:454), or one plasmid encoding all cas genes as a polycistronic construct and a second plasmid encoding the minimal CRISPR array ("two plasmid"-delivery system, SEQ ID NO:454 and SEQ ID NO:455).

B. Transfection of Plasmid(s)-Encoding FokI-Cascade Complex RNPs

Transfection conditions for the six plasmid-delivery system and two plasmid-delivery systems were performed as detailed in Example 8 with the following modifications. Prior to nucleofection, 5 µl of plasmid vector solution was transferred to individual wells of a 96-well plate. The six plasmid-delivery system was initially tested by examining the necessity of each component for genome editing. More specifically, plasmid "cocktails" were added to each well such that there was a constant amount (420 ng) of five plasmids and a variable amount of the sixth plasmid (either 0 ng, 70 ng, 700 ng, or 1,400 ng). Next, the six plasmid delivery system and the two plasmid-delivery system were compared by nucleofecting in a fixed amount (3.5 µg) of total plasmid DNA while varying the ratio of minimal CRISPR array plasmid to cas-encoding plasmid(s). Finally, lysate was harvested ~72 hours after nucleofection for subsequent deep sequencing analysis.

C. Deep Sequencing of gDNA from Transfected Cells and Data Analysis

Deep sequencing was performed as detailed in Example 8, but only using target-specific primers Y and Z from Table 31.

D. Deep Sequencing Data Analysis

Figure 30:
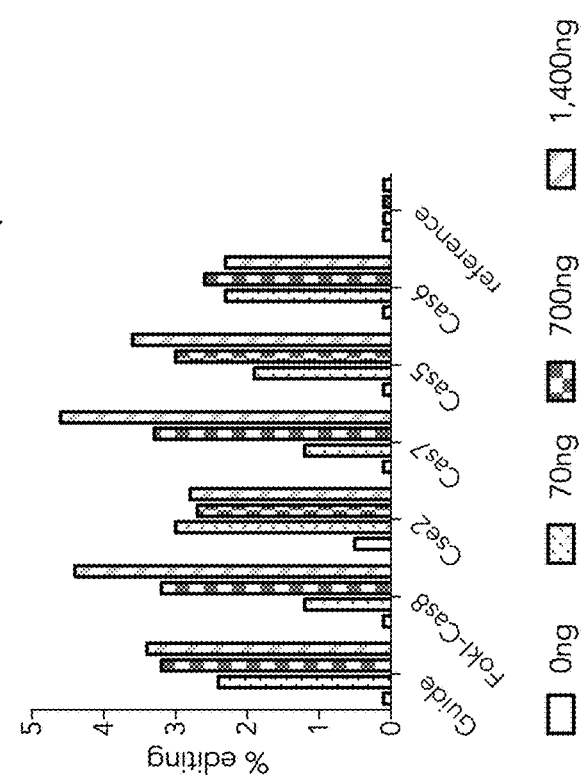

Deep sequencing data analysis was performed as detailed in Example 8. FIG. 30 shows genome editing at the TRAC locus as a function of each FokI-Cascade component in the six plasmid-delivery strategy (n=1). As is shown, editing was abolished or dramatically reduced (in the case of Cse2) if a given component was lacking. This confirms that each Cascade component is necessary for editing via plasmid delivery.

Figure 31:
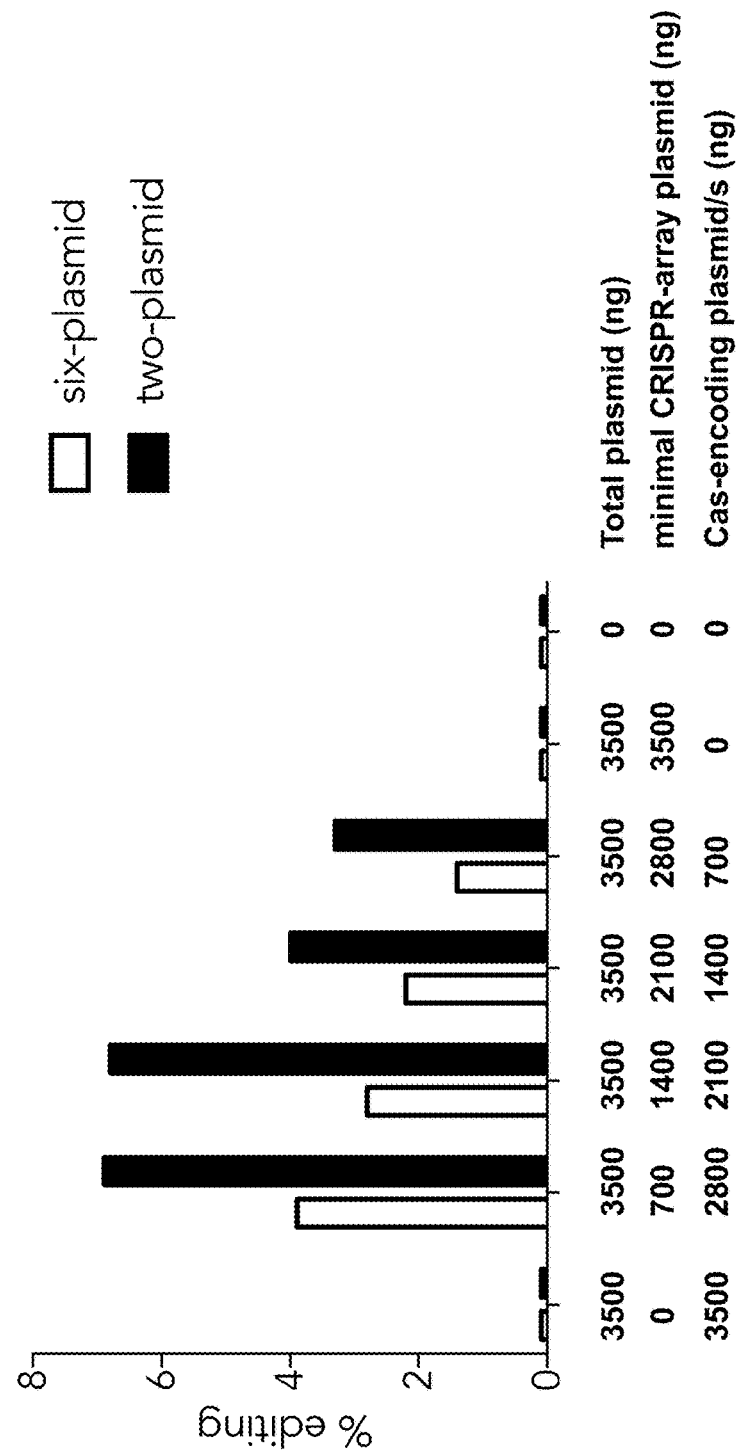

FIG. 31 shows data comparing genome editing with the six plasmid-delivery system or the two plasmid-delivery system. Across both methods, the highest levels of editing were achieved with the highest ratio of cas:minimal CRISPR array plasmids. Additionally, the polycistronic plasmid enabled higher levels of editing, potentially due to increased transcription per µg of plasmid.

Example 10

Circular Permutations of Cascade Subunit Proteins

This Example illustrates in silico design, cloning, expression, and purification of a circularly-permuted (cp) E. coli Type I-E Cas7 protein using a structure-guided modelling approach.

A. In Silico Design

An E. coli Type I-E Cas7 protein (SEQ ID NO:18) was circularly permuted using a structure-guided approach based on the E. coli Cascade crystal structure 5H9E.pdb (www.rcsb.org/pdb/; Hayes, R. P, et al., Nature 530(7591):499-503 (2016)). The native Cas7 N-terminus and C-terminus were connected with a two-amino acid peptide linker having the sequence glycine-serine (G-S). The polypeptide sequence of this circularized Cas7 was opened at the position corresponding to the peptide bond between residues 301 and 302 in wild-type Cas7 polypeptide sequence to form a new N-terminus (residue 302) and a new C-terminus (residue 301), resulting in a circular permuted version of Cas7 protein (cp-Cas7 V1 protein). The new N-terminus and new C-terminus were designed to be positioned for connection with a fusion protein or linker region without disturbing the Cas7 protein fold or the Cascade complex assembly. A methionine residue was added to the new N-terminus (i.e., the amino acid residue corresponding to residue 302 of the wild-type Cas7 protein) of the cp-Cas7 V1 protein (SEQ ID NO:578).

A second cp-Cas7 protein, cp-Cas7 V2 protein, was similarly engineered using the G-S linker. The N-terminus and C-terminus of the cp-Cas7 V2 protein correspond to residues 338 and 339, respectively, in the wild-type Cas7 sequence. The new N-terminus and new C-terminus were designed to be positioned for connection with a fusion protein or linker region without disturbing the Cas7 protein fold or the Cascade complex assembly. A methionine residue was added to the N-terminus (i.e., the amino acid residue corresponding to residue 339 of the wild-type Cas7 protein) of the cp-Cas7 V2 protein (SEQ ID NO:579).

B. Cloning, Expression, and Purification of Cascade Complexes Comprising Cp-Cas7

DNA coding sequences of the in silico designed polypeptide sequences of cp-Cas7 V1 protein and cp-Cas7 V2 protein were codon optimized for expression in E. coli.

These DNA coding sequences were provided to a commercial manufacturer (GenScript, Piscataway, N.J.) for synthesis. The DNA sequences were individually introduced into a Cascade-operon expression vector (Table 14; SEQ ID NO:441) to replace the wild-type Cas7 protein in the expression vector as described in Example 2.

Each expression vector was transfected into E. coli BL21 Star™ cells (Thermofisher, Waltham, Mass.) with a second vector encoding a guide RNA for the J3 target (SEQ ID NO:444) Table 15, as described in Example 2. Cells were cultured as described in Example 4. E. coli Type I-E Cascade complexes containing Cas5, Cas6, cp-Cas7 V1, Cse2, and Cas8 proteins, as well as guide RNA/target J3; and Cas5, Cas6, cp-Cas7 V2, Cse2, and Cas8 proteins as well as guide RNA/target J3, were purified as described in Example 5.

Purification of the Cascade complexes comprising the circularly-permuted Cas7 variants demonstrate that circularly-permuted Type I-E CRISPR-Cas subunit proteins can be successfully used to form Cascade complexes having essentially the same composition (based on molecular weight) as Cascade complexes comprising wild-type proteins.

C. EMSA (Electrophoretic Mobility Shift Assays) of Cascade/Cp-Cas7 and J3 Target Purified Cascade/cp-Cas7 complexes were purified as described in this Example and subjected to an EMSA to demonstrate specific binding to their respective target sequence. Briefly, Cascade/cp-Cas7 and Cascade/WT-Cas7 were purified and concentrated to 10 mg/mL. Cy5 double-stranded target DNA was produced as described in Example 6 and diluted to 1 µM in TE buffer (J3 target SEQ ID NO:469 and SEQ ID NO:472 and CCR5 target SEQ ID NO:474 and SEQ ID NO:470). Cascade complexes and labeled double-stranded target DNA were incubated for 30 min at 37° C. at different protein/target ratios. Immediately following the incubation, 2 µl of 50% glycerol was added to the samples and they were loaded on a 5% native PAA gel. Gels were run at 4° C. at 70V for 90 min in 0.5×TBE buffer and imaged on an AZURE c600 Bioimager (Azure BioSystems, Dublin, Calif.) and the bands were quantitated. The data are presented in Table 32.

TABLE 32

Results of Cascade/cp-Cas7 V2 EMSA

| Cascade ID and guide | Target DNA | Cascade:dsDNA ratio | Gel shift % |
|---|---|---|---|
| Cascade/WT-Cas7 J3 | J3 | 6.7 | 44 |
| Cascade/cp-Cas7 V2 J3 | J3 | 6.7 | 90 |
| Cascade/WT-Cas7 J3 | CCR5 | 6.7 | LOD* |
| Cascade/cp-Cas7 V2 J3 | CCR5 | 6.7 | LOD |

*LOD = below the limit of detection

Example 11

Cascade Subunit Fusion Proteins

A. Cascade Subunit Fusion with FokI

This Example illustrates in silico design, cloning, expression, and purification of a E. coli Type I-E Cas8 protein fused to a FokI nuclease domain to confer nuclease activity to the Cascade complex.

E. coli Type I-E Cas8 was fused N-terminally with a Flavobacterium okeanokoites FokI nuclease domain (GenBank no. AAA24927.1). The FolkI nuclease domain comprises residues contained in the Sharkey variant described by Guo, et al. (Guo, J., et al., J. Mol. Biol. 400:96-107 (2010)), and catalyzes double-stranded DNA cleavage upon homodimerization. The amino acid sequence for the FokI nuclease (SEQ ID NO:580) contained residues Q384 to F579 (GenBank no. AAA24927.1) and had the following point mutations: E486Q, L499I, and D469N. Briefly, the FolkI Sharkey nuclease domain (SEQ ID NO:581) was fused N-terminal to Cas8 using a linker sequence (SEQ ID NO:582). For purification purposes, a hexahistine tag (His6, SEQ ID NO:583), followed by a MBP tag (SEQ ID NO:584), followed by a TEV protease cleavage sequence (SEQ ID NO:585), a nuclear localization signal (NLS, SEQ ID NO:586), and a GGS linker were appended N-terminal to residue 384 of FolkI. The final construct comprised NH3-His6-MBP-TEV-NLS-GGS-FokISharkey-30aa-linker-Cas8-COOH in the protein sequence (SEQ ID NO:413).

In silico designed DNA sequences were provided to a commercial manufacturer (GenScript, Piscataway, N.J.) for synthesis. The DNA sequences were cloned into a pET expression (MilliporeSigma, Hayward, Calif.) family vector backbone, which confers kanamycin resistance due to the presence of the kanR gene as described in Example 2 resulting in a vector carrying NH3-His6-MBP-TEV-NLS-GGS-FokISharkey-30aa-linker-Cas8-COOH (SEQ ID NO:439).

The E. coli Type I-E Cascade H3-His6-MBP-TEV-NLS-GGS-FokISharkey-30aa-linker-Cas8-COOH (SEQ ID NO:439) was expressed and purified as described in Example 4 and Example 5C. The protein sequence after TEV cleavage comprises NH3-NLS-GGS-FokISharkey-30aa-linker-Cas8-COOH (SEQ ID NO:587).

Similarly, a FokI-Cas8 fusion protein was constructed in a vector that carries NLS-FokI-linker-Cas8_His6-HRV3C-Cse2_Cas7_Cas5_Cas6 as described in Examples 1 and 2 (SEQ ID NO:442). Each expression vector was transfected into E. coli BL21 Star™ cells (Thermofisher, Waltham, Mass.) with a second vector encoding a guide RNA for the J3 target (SEQ ID NO:414), as described in Example 2. This construct was expressed and purified as described in Example 4B and Example 5A. Purification of the Cascade complexes comprising the fused FokI-Cas8 variants demonstrate that nuclease fused Type I-E CRISPR-Cas subunit proteins can be successfully used to form Cascade complexes having essentially the same composition (based on molecular weight) as Cascade complexes comprising wild-type proteins. FokI-Cas8 fusions were successfully used for biochemical cleavage of target nucleic acid (Example 7) and for in-cell cleavage of genomic sequences in eukaryotic cells (Examples 8 and 9).

Table 33 lists further examples of Cas subunit protein-enzyme fusions. In Table 33, APOBEC corresponds to a gene that is member of the cytidine deaminase pathway (human APOBEC I Genbank no. AB009426, human APOBEC 3F Genbank no. CH471095, human APOBEC 3G Genbank no. CR456472, rat APOBEC UCSC genome browser ID RGD:2133 rat); AID corresponds to an activation-induced cytidine deaminase (Genbank no. AY536516); PmCDA1 is an AID ortholog (Nishida, et al., Science 16:353 (2016); Iwamatsu, et al., J Biochem 110:151-158 (1991));

PvuIIHIFIT46G is a PvuII high fidelity variant T46G (Fonfara, et al., Nucleic Acids Res, 40:847-860 (2012)); PvuIIsinglechainT46G is described in pdbID 3KSK); I-TevI is a site-specific, sequence-tolerant homing endonuclease from bacteriophage T4 and comprises an N-terminal catalytic domain as well as a C-terminal DNA-binding domain (the domains are connected by a long, flexible linker) (Van Roey, et al., EMBO J, 20:3631-3637 (2001)); BcnI (Sokolowska, et al., J Mol Biol 369:722-734 (2007)); and MvaI (Kaus-Drobek, et al., Nucleic Acids Res 35:2035-2046 (2007)) are restriction enzymes.

TABLE 33

Other Enzyme Fusions such as Nucleases and Cytidine Deaminases with Cas8

| SEQ ID NO: | Enzyme | Fusion to Cas8 |
|---|---|---|
| SEQ ID NO:593 | Cas8_rAPOBEC1 | C terminal |
| SEQ ID NO:594 | Cas8_AID | C terminal |
| SEQ ID NO:595 | Cas8_PmCDA1 | C terminal |
| SEQ ID NO:596 | Cas8_Human APOBEC1 | C terminal |
| SEQ ID NO:597 | Cas8_APOBEC3F | C terminal |
| SEQ ID NO:598 | Cas8_APOBEC3G | C terminal |
| SEQ ID NO:599 | PvuIIHIFIT46G | N terminal |
| SEQ ID NO:600 | PvuIIsinglechainT46G | N terminal |
| SEQ ID NO:601 | I-TevI1-169Q158R | N terminal |
| SEQ ID NO:602 | I-TevI1-169 | N terminal |
| SEQ ID NO:603 | BcnI singlechain | N terminal |
| SEQ ID NO:604 | MvaI singlechain | N terminal |
| SEQ ID NO:605 | DNaseI | N terminal, C terminal |
| SEQ ID NO:606 | Cas3 | N terminal |
| SEQ ID NO:607 | S1Aspergillus | N terminal, C terminal |

B. Cascade Subunit Protein Fusion with Another Cascade Subunit Protein

The two Cse2 proteins of the Cascade complex were fused together using a structure-guided approach based on the E. coli Cascade crystal structure 5H9E.pdb (www.rcsb.org/pdb/; Hayes, R. P, et al., Nature 530(7591):499-503 (2016)). Briefly, the C-terminus of one Cse2 and the N-terminus of a second Cse2 were fused together using a 10-aa flexible linker (SEQ ID NO:589). The full sequence of the Cse2-Cse2 (CasB_CasB) fusion protein is shown in SEQ ID NO:588.

In silico designed DNA sequences were provided to a commercial manufacturer (GenScript, Piscataway, N.J.) for synthesis. The DNA sequences were cloned into the expression vector designed in Example 2 (SEQ ID NO:441). The Cse2 sequence was exchanged with SEQ ID NO:588.

Each expression vector was transfected into E. coli BL21 Star™ cells (Thermofisher, Waltham, Mass.) with a second vector encoding a guide RNA for the J3 target (SEQ ID NO:444), as described in Example 2. The E. coli Type I-E Cascade complex containing Cas5, Cas6, Cas7, Cse2-Cse2, and Cas8 was expressed and purified as described in Example 4B and 5B. Purification of the Cascade complexes comprising the fused Cse2-Cse2 variant demonstrate that fused Type I-E CRISPR-Cas subunit proteins successfully formed Cascade complexes having essentially the same composition (based on molecular weight) as Cascade complexes comprising wild-type proteins.

C. Electrophoretic Mobility Shift Assays (EMSA) of Cascade/Cse2-Cse2 and J3 Target Purified Cascade/Cse2-Cse2 complexes were purified as described in this Example and subjected to an EMSA to demonstrate specific binding to their respective target sequence. Briefly, Cascade/Cse2-Cse2 and Cascade/WT-Cse2 were purified and concentrated to 10 mg/mL. Cy5 double-stranded target DNA was produced as described in Example 6 and diluted to 1M in TE buffer (J3 target SEQ ID NO:469 and SEQ ID NO:472 and CCR5 target SEQ ID NO:474 and SEQ ID NO:470). Cascade complexes and labeled double-stranded target DNA were incubated for 30 min at 37° C. at different protein/target ratios. Immediately following the incubation, 2 µl of 50% glycerol was added to the samples and they were loaded on a 5% native PAA gel. Gels were run at 4° C. at 70V for 90 min in 0.5×TBE buffer and imaged on an AZURE c600 Bioimager (Azure BioSystems, Dublin, Calif.) and the bands were quantitated. The data are presented in Table 34.

TABLE 34

Results of Cascade/Cse2-Cse2 EMSA

| Cascade ID and guide | Target DNA | Cascade:dsDNA ratio | Gel shift % |
|---|---|---|---|
| Cascade/WT-Cse2 J3 | J3 | 6.7 | 44 |
| Cascade/Cse2-Cse2 J3 | J3 | 6.7 | 46 |
| Cascade/WT-Cse2 J3 | CCR5 | 6.7 | LOD* |
| Cascade/Cse2-Cse2 J3 | CCR5 | 6.7 | LOD |

*LOD = below the limit of detection

D. Cascade Subunit Protein Fusion with Another Cascade Subunit Protein and an Enzymatic Protein Domain The cytidine deaminase rAPOBEC1 (apolipoprotein B mRNA editing enzyme catalytic subunit 1, Rattus norvegicus; NCRI Gene ID: 25383, uEnsembl:ENSRNOG00000015411) was selected for fusion. The Cse2-Cse2 protein was fused with rAPOBEC1 using a structure-guided approach based on the E. coli Cascade crystal structure 5H9E.pdb (www.rcsb.org/pdb/; Hayes, R. P, et al., Nature 530(7591):499-503 (2016)). Briefly, the C-terminus of rAPOBEC1 (SEQ ID NO:590) was fused to the N-terminus of the Cse2-Cse2 dimer (described above) using a 9-aa flexible linker (SEQ ID NO:591). The full sequence of the rAPOBEC1_Cse2-Cse2 fusion protein is shown in SEQ ID NO:592.

In silico designed DNA sequences were provided to a commercial manufacturer (GenScript, Piscataway, N.J.) for synthesis. The DNA sequences were cloned into the expression vector (SEQ ID NO:441), replacing the Cse2 sequence. Each expression vector was transfected into E. coli BL21 Star™ cells (Thermofisher, Waltham, Mass.) with a second vector encoding a guide RNA for the J3 target (SEQ ID NO:444), as described in Example 2. The E. coli Type I-E Cascade complex containing Cas5, Cas6, Cas7, TAPOBEC1_Cse2-Cse2, and Cas8 was expressed and purified as described in Example 4B and 5B. Purification of the Cascade complexes comprising the fused rAPOBEC1_Cse2-Cse2 variant demonstrate that cytidine deaminase fusions to Type I-E CRISPR-Cas subunit proteins were successfully used to form Cascade complexes having essentially the same composition (based on molecular weight) as Cascade complexes comprising wild-type proteins. Table 35 presents examples of enzyme fusions with Cse2-Cse2.

TABLE 35

Other Enzyme Fusions Such as Cytidine Deaminases with Cse2-Cse2

| SEQ ID NO: | Enzyme | Fusion to Cse2-Cse2 |
|---|---|---|
| SEQ ID NO:608 | rAPOBEC1 | N terminal |
| SEQ ID NO:609 | AID | C terminal |

TABLE 35-continued

Other Enzyme Fusions Such as Cytidine Deaminases with Cse2-Cse2

| SEQ ID NO: | Enzyme | Fusion to Cse2-Cse2 |
|---|---|---|
| SEQ ID NO:610 | CPmCDA1 | C terminal |
| SEQ ID NO:611 | Human APOBEC1 | N terminal |
| SEQ ID NO:612 | Human APOBEC3F | N terminal |
| SEQ ID NO:613 | APOBEC3G | N terminal |

Example 12

Cascade Subunit Protein Fusions to Transcription Activation/Repression Domains

This Example illustrates the design of a E. coli Type I-E cp-Cas7 protein fused to a VP64 activation domain to confer transcriptional activation activity to the Cascade complex.

VP64 is a transcriptional activator comprising four tandem copies of VP16 (herpes simplex viral protein 16, DALDDFDLDML (SEQ ID NO:614); amino acids 437-447, UNIPROT:UL48) connected with glycine-serine (GS) linkers. When fused to a protein domain that can bind near the promoter of a gene, VP64 (SEQ ID No:615) acts as a strong transcriptional activator. The E. coli Type I-E cp-Cas7 V2 (SEQ ID NO:616) can be selected for engineering.

The activation domain VP64 can be fused to the N-terminus of cpCas7 V2 (described in Example 10). A linker (e.g., 5 to 50 amino acids in length) can be selected to operably link cpCas7 V2 and the VP64 domain.

In silico designed DNA sequences can be provided to a commercial manufacturer for synthesis. The DNA sequences encoding a VP64-cpCas7 V2 fusion protein can be cloned into an expression vector (e.g., SEQ ID NO:455, wherein VP64-cpCas7 V2 can be substituted for Cas7). Each expression vector can be transfected into E. coli BL21 Star™ cells (Thermofisher, Waltham, Mass.) with a second vector encoding a guide RNA for the J3 target (SEQ ID NO:444), as described in Example 2. The E. coli Type I-E Cascade complex containing Cas5, Cas6, VP64_cpCas7 V2, Cse2, and Cas8 can be expressed and purified as described in Examples 4 and 5. Purification of the Cascade complexes comprising the fused VP64_cpCas7 V2 variant can be used to form Cascade complexes having essentially the same composition (based on molecular weight) as Cascade complexes comprising wild-type proteins.

Selection of a guide targeted to the promoter region of a particular gene can be used to verify the ability of the Cascade complex comprising the fused VP64_cpCas7 V2 to facilitate transcriptional activation of the gene.

Example 13

Site-Directed Recruitment of Functional Domains Fused to Cascade Subunit by dCas9/Guide Complex This Example describes a method of modifying a Class 2 Type II CRISPR sgRNA, crRNA, tracrRNA, or crRNA and tracrRNA sequence with a Class 1 Type I CRISPR repeat stem sequence (e.g., a Type I-F CRISPR repeat stem sequence) for the recruitment of one or more Cascade subunit proteins (i.e., Cas6, Cas5, etc.) fused to a functional domain, to a Type II CRISPR Cas protein/guide RNA complex binding site. This method here is adapted from Gilbert, L et. al., Cell 154(2):442-451 (2013) and Ferry, Q et. al., Nature Communication 8, 14633 doi: 10.1038/ncomms14633 (2017).

A. Modifying a Type II Guide RNA

A Type II CRISPR sgRNA, crRNA, tracrRNA, or crRNA and tracrRNA (collectively referred to a "Type II guide RNA") can be selected for engineering.

A Type II guide RNA sequence can be evaluated in silico for regions of incorporation of a Type I CRISPR repeat stem sequence. The Type I CRISPR repeat stem sequence can be attached at the 5' or 3' end of the Type II guide RNA, internal to the Type II guide RNA, or can replace secondary structure in the Type II guide RNA (e.g., 3' hairpin elements). Incorporation of the Type I CRISPR repeat stem sequence can be accompanied by a linker element nucleotide sequence. An example of a Type II tracrRNA 3' modified with a Type I CRISPR repeat stem sequence is presented in Table 36.

TABLE 36

Exemplary Type II tracrRNA with 3' Type I CRISPR Repeat Stem Sequence

| SEQ ID NO: | Sequence* |
|---|---|
| SEQ ID NO: 617 | 5'-AGCAUAGCAAGUUAAAAUAAGGCUAGUCCGUUA UCAACUUGAAAAAGUGGCACCGAGUCGGUGCUU AAGUUCAcugccguauaggcagCUUU-3' |

*Type I CRISPR repeat stem sequence is underlined and in lower case letters. A corresponding DNA coding sequence is presented as SEQ ID NO:618.

A mammalian gene, such as C—X—C chemokine receptor type 4 (CXCR4), can be selected for targeting. The junction between the 5' UTR and exon 1 can be scanned in silico for a Type II CRISPR Cas protein target sequence occurring adjacent a Type II CRISPR Cas protein PAM sequence (e.g., 5'-NGG). The 20-nucleotide target sequence occurring upstream, in a 5' direction, can be incorporated into the Type II crRNA. An example of a Type II crRNA targeting CXCR4 is shown in Table 37.

TABLE 37

Exemplary Type II crRNA Targeting CXCR4

| SEQ ID NO: | Sequence* |
|---|---|
| SEQ ID NO:619 | 5'-GAACCAGCGGUUACCAUGGAGUUUUAGAGC UAUGCU-3' |

*A corresponding DNA coding sequence is presented as SEQ ID NO:620.

Alternatively, the 3' end of the CXCR4 targeting spacer (RNA) (SEQ ID NO:619) can be covalently linked to the 5' end of the Type II tracrRNA with 3' Type I CRISPR repeat stem sequence (RNA) (SEQ ID NO:617) with a linker. A suitable linker element is 5'-GAAA-3'.

In silico designed Type II guide RNAs with the incorporated Type I CRISPR repeat stem sequence can be provided to a commercial manufacturer for synthesis.

A Type I Cascade subunit protein (e.g., Cas6) can be operably linked to a transcriptional activation or repression domain (e.g., KRAB) and c-terminally tagged with a nuclear localization signal (NLS) as described in Example 12.

A Type II Cas protein (e.g., Cas9) can be mutated such that it is catalytically inactive (e.g. dCas9) and tagged with a NLS sequence.

The Cas6-KRAB-NLS protein and the dCas9-NLS protein can be recombinantly expressed and purified from E. coli.

Ribonucleoprotein complexes can be formed at a concentration of 60 pmol dCas9 protein:60 pmol Cas6-KRAB-NLS:120 pmol:CXCR4 targeting crRNA:120 pmol tracrRNA 3' modified with a Type I CRISPR repeat stem sequence. Prior to assembly with the dCas9 and the Cas6-KRAB-NLS, each of the 120 pmol CXCR4 targeting crRNA and 120 pmol tracrRNA 3' modified with a Type I CRISPR repeat stem sequence (herein referred to as "modified Type II guide RNA") can be diluted to the desired total concentration (120 pmol) in a final volume of 2 µL, incubated for 2 minutes at 95° C., removed from a thermocycler, and allowed to equilibrate to room temperature. dCas9 and the Cas6-KRAB-NLS protein can be diluted to an appropriate concentration in binding buffer (20 mM HEPES, 100 mM KCl, 5 mM $MgCl_2$, and 5% glycerol at pH 7.4) to a final volume of 3 µL and mixed with the 2 µL of Type II guide RNA, followed by incubation at 37° C. for 30 minutes. A nontransfected control (e.g., buffer only), unmodified Type II guide RNA, or a Cas6 not linked to a repression domain, can be used to assemble negative control RNPs.

B. Cell Transfections Using dCas9:Cas6-KRAB-NLS: Modified Type II Guide RNA dCas9:Cas6-KRAB-NLS: modified Type II guide RNA nucleoprotein complexes can be transfected into HEK293 cells (ATCC, Manassas Va.), using the Nucleofector® 96-well Shuttle System (Lonza, Allendale, N.J.) and the following protocol: The complexes can be dispensed in a 5 µL final volume into individual wells of a 96-well plate. The cell culture medium can be removed from the HEK293 cell culture plate and the cells detached with TrypLE™ (Thermo Scientific, Wilmington, Del.). Suspended HEK293 cells can be pelleted by centrifugation for 3 minutes at 200×g, TrypLE reagents aspirated, and cells washed with calcium and magnesium-free phosphate buffered saline (PBS). Cells can be pelleted by centrifugation for 3 minutes at 200×g, the PBS aspirated, and the cell pellet re-suspended in 10 mL of calcium and magnesium-free PBS.

The cells can be counted using the Countess® II Automated Cell Counter (Life Technologies; Grand Island, N.Y.). $2.2 \times 10^7$ cells can be transferred to a 1.5 ml microfuge tube and pelleted. The PBS can be aspirated and the cells re-suspended in Nucleofector™ SF (Lonza, Allendale, N.J.) solution to a density of $1 \times 10^7$ cells/m. 204 of the cell suspension can be then added to each individual well containing 5 pt of ribonucleoprotein complexes, and the entire volume from each well can be transferred to a well of a 96-well Nucleocuvette™ Plate (Lonza, Allendale, N.J.). The plate can be loaded onto the Nucleofector™ 96-well Shuttle™ (Lonza, Allendale, N.J.) and cells nucleofected using the 96-CM-130 Nucleofector™ program (Lonza, Allendale, N.J.). Post-nucleofection, 70 µL Dulbecco's Modified Eagle Medium (DMEM; Thermo Scientific, Wilmington, Del.), supplemented with 10% Fetal Bovine Serum (FBS; Thermo Scientific, Wilmington, Del.), penicillin and streptomycin (Life Technologies, Grand Island, N.Y.) can be added to each well, and 50 µL of the cell suspension can be transferred to a 96-well cell culture plate containing 150 µL pre-warmed DMEM complete culture medium. The plate can be transferred to a tissue culture incubator and maintained at 37° C. in 5% $CO_2$ for 48 hours.

72 hours after nucleofection of the dCas9:Cas6-KRAB-NLS: modified Type II guide RNA nucleoprotein complexes, cells can be evaluated for repression of CXCR4 expression. Culture medium can be aspirated from the HEK293, and the cells can be washed once with calcium and magnesium-free PBS then are trypsinized by the addition of TrypLE (Life Technologies, Grand Island, N.Y.) followed by incubation at 37° C. for 3-5 minutes. Trypsinized cells can be gently pipetted up and down to form a single cell suspension, and the cells can then be pelleted by centrifugation for 3 minutes at 200×g. After centrifugation the culture medium can be aspirated and cells are re-suspended in a 10 mM EDTA/PBS buffer and gently mixed into a singles cell suspension. The single-cell suspension can be stained using 0.05% FITC conjugated to an anti-human CXCR4 antibodies (Medical & Biological Laboratories Co., Japan) in PBS containing 10% FBS for 1 hour at room temperature. Isotype controls and native RNP controls can be similarly stained for reference. Stained cells can then be sorted LSR II flow cytometer (BD laboratories, San Jose Calif.) and population of FITC positive fluorescent cells tallied.

Reduction in CXCR4 expression is measure by a decrease in detected fluorescence of a dCas9:Cas6-KRAB-NLS: modified Type II guide RNA nucleofected sample compared to the measured fluorescence of a non-transfected control. Decrease in fluorescence from the flow cytometer can be used to demonstrate that a modified Type II guide RNA with a Type I CRISPR repeat stem sequence can be used in combination with a nuclease-deficient Type II Cas9 protein to recruit and localize a Type I CRISPR Cascade subunit protein fused to repression domain to a gene target and repress transcription of said gene target.

Example 14

Identification and Screening of Type I Cas Genes

This Example describes a method to identify and screen Type I cas genes from different species. The method presented here is adapted from Shmakov, S., et al., Molecular Cell 60(3):385-397 (2015).

A. Identification of Type I CRISPR-Cas Genes

Using the Basic Local Alignment Search Tool (BLAST, blast.ncbi.nlm.nih.gov/Blast.cgi), a search of the genomes of various species can be conducted to identify one or more genes coding for the various gene component of the Type I CRISPR-Cas complex. The cas1 integrase gene is a component of both Class 1 and Class 2 CRISPR-Cas families, and upon identification of species containing the cas1 gene, subsequence searcher in these genomes can be conducted to isolate genomes comprising Type I-specific genes. Genome searches can be anchored upon the CRISPR-Cas integrase genes cas1, an exemplary cas1 sequence from the Type I-E system from *E. coli* K-12 MG1655 that can be used is SEQ ID. NO:621. Particular genes (e.g., cas7 and cas5) are core components of the interference complexes of the Type I systems and can be used to further differentiate species containing Type I systems. Exemplary sequences of *E. coli* K-12 MG1655 cas7 and cas5 genes that can be used are SEQ ID. NO:622 and SEQ ID. NO:623, respectively. Genomes identified possessing cas7 and cas5 genes can be further parsed through the identification of the Type I-specific nuclease-helicase cas3 gene or homologs thereof. An exemplary sequences of a *E. coli* K-12 MG1655 cas3 sequence that can be used is SEQ ID. NO:624.

Genomes containing CRISPR-Cas integrase genes cas1, Type I interference complex genes cas7 and cas5, and the nuclease-helicase cas3 gene, or some combination thereof, are likely candidates of Type I CRISPR-Cas system(s). Type I CRISPR-Cas genes are generally found in proximity to one in a single genomic locus, typically within 20 kilobases (kb). The area around the cas1, cas7, cas5, or cas3 genes can be searched for other open reading frames (ORFs) of the remaining cas genes that constitute a Type I interference complex. The amino acid sequence of putative ORFs can be compared to known Type I genes for homology or the presence of characteristic protein domains of the Type I protein components can be analyzed using the homology detection and structure prediction search tools available through the Max Planck Institute Bioinformatics Toolkit (https://toolkit.tuebingen.mpg.de/#/), or equivalent.

B. Screening of Identified Type I Components

Once a putative collection of Type I components (e.g., cas genes and the corresponding crRNA) have been identified, the Type I components can be tested for their ability to carry out programmable DNA targeting.

Putative cas genes and the crRNA can be encoded into expression vectors following the guidance of Examples 1, 2, and 3. Vectors encoding the various cas genes and crRNA can be introduced into a bacteria strain and the Type I interference complex expressed and purified as described in Examples 4 and 5. The elution fraction from the size-exclusion chromatography (SEC) column, can be analyzed via SDS-PAGE gel to determine the identity, based on weight, of the protein components comprising a complete Type I interference complex. An ethidium bromide gel can also be run to detect the presence of crRNA as part of the interference complex.

Purified Cascade complexes can be tested for their ability to support in vitro biochemical cleavage of a DNA target as described in Examples 6 and 7.

Control expressions and purification samples, where single putative cas gene are not expressed, can be used to determine the required cas genes that constitute a complete Type I interference complex capable of programmable DNA target.

For certain applications, identification of individual cas gene homologs (e.g., cas7) from a genomic sequence is sufficient and additional cas genes need not be identified nor screening performed.

Example 15

Identification of Type I crRNAs

This Example describes a method to identify Type I crRNAs in different species. The method presented here is adapted from Chylinski, K., et al., RNA Biology 10(5):726-737 (2013).

A search of genomes of various species can be conducted to identify Type I CRISPR-Cas genes as described in Example 17A. Genomes that comprise one of more Type I specific cas genes are candidate genomes that likely to contain CRISPR RNAs (crRNAs) encoded within the CRISPR repeat-spacer array. The sequences adjacent to the identified Type I cas genes (e.g., a cas7, cas5, or cas3 gene) can be probed for an associated CRISPR repeat-spacer array. Methods for in silico predictive screening can be used to extract the crRNA sequence from the repeat array following Grissa, I. V., et. al. Nucleic Acids Research 35 (Web Server issue):W52-W57 (2007). The crRNA sequence is contained within CRISPR repeat array and can be identified by its hallmark repeating sequences interspaced by foreign spacer sequences.

A. Preparation of RNA-Seq Library

The putative CRISPR array containing the individual crRNA identified in silico can be further validated using RNA sequencing (RNA-seq).

Cells from species identified as comprising putative Type I cas genes and crRNA components can be procured from a commercial repository (e.g., ATCC, Manassas, Va.; German Collection of Microorganisms and Cell Cultures GmbH (DSMZ), Braunschweig, Germany).

Cells can be grown to mid-log phase and total RNA prepped using Trizol reagent (SigmaAldrich, St. Louis, Mo.) and treated with DNaseI (Fermentas, Vilnius, Lithuania).

10 μg of the total RNA can be treated with Ribo-Zero rRNA Removal Kit (Illumina, San Diego, Calif.) and the remaining RNA purified using RNA Clean and Concentrators (Zymo Research, Irvine, Calif.).

A library can be prepared using a TRUSEQ™ Small RNA Library. Preparation Kit (Illumina, San Diego, Calif.), following the manufacturer's instructions. This will result in cDNAs having adapter sequences.

The resulting cDNA library can be sequenced using MiSeq Sequencer (Illumina, San Diego, Calif.).

B. Processing of Sequencing Data

Sequencing reads of the cDNA library can be processed, for example, using the following method.

Adapter sequences can be removed using cutadapt 1.1 (pypi.python.org/pypi/cutadapt/1.1) and about 15 nucleotides trimmed from the 3'end of the read to improve read quality.

Reads can be aligned to the genome of the respective species (i.e., from which the putative crRNA is to be identified) using Bowtie 2 (http://bowtie-bio.sourceforge.net/bowtie2/index.shtml). The Sequence Alignment/Map (SAM) file, which is generated by Bowtie 2, can be converted into a Binary Alignment/Map (BAM) file using SAMTools (http://samtools.sourceforge.net/) for subsequent sequencing analysis steps.

Read coverage mapping to the CRISPR locus or loci can be calculated from the BAM file using BedTools (bedtools.readthedocs.org/en/latest/).

The BED file, as generated in the previous step, can be loaded into Integrative Genomics Viewer (IGV; www.broadinstitute.org/igv/) to visualize the sequencing read pileup. Read pile can be used to identify the 5' and 3' termini of the transcribed putative crRNA sequence. The RNA-seq data can be used to validate that a putative crRNA element is actively transcribed in vivo.

Putative crRNA can be tested with their cognate Type I cas genes for the ability to carry, out programmable DNA targeting, following the guidance of Example 17.A of the present Specification.

Example 16

Probing for Sites Tolerant of Modification in Cascade Guide RNA Backbones

This Example describes the generation and testing of various modifications of Type I guide crRNAs and their suitability for use in constructing Cascade polynucleotide complexes. The method described below is adapted from Briner, A., et al., Molecular Cell 56(2):333-339 (2014).

Modifications can be introduced into the crRNA backbone, and the modified crRNA tested with a cognate Cascade complex to facilitate the identification of regions or positions in the Type I guide crRNA backbone amenable to modification.

A crRNA from a Type I CRISPR system (e.g., *E. coli* Cascade) can be selected for engineering. The crRNA sequence can be modified in silico to introduce one or more base substitutions, deletions, or insertions into nucleic acid sequences in regions selected from one or more of the following regions: nucleic acid sequences 5' of the spacer (5' handle), the spacer element, Type I CRISPR repeat stem sequence, or 3' of the Type I CRISPR repeat stem sequence (3' handle).

Base modification can also be used to introduce mismatches in the hydrogen base-pair interactions of any of the crRNA regions, or base-pair mutation introducing an alternative hydrogen base-pair interaction through substitution of two bases, wherein the alternative hydrogen base-pair interaction differs from the original hydrogen base-pair interaction (e.g., the original hydrogen base-pair interaction is Watson-Crick base pairing and the substitution of the two bases form a reverse Hoogsteen base pairing). Substitution of bases can also be used to introduce hydrogen base-pair interaction within the crRNA backbone.

Regions of the crRNA can be independently engineered to introduce secondary structure elements into the crRNA backbone. Such secondary structure elements include, but are not limited to, the following: stem-loop elements, stem elements, pseudo-knots, and ribozymes. Furthermore, the crRNA guide RNA backbone can be modified to delete portions of the crRNA backbone either through deletion at the 5' end, 3' end, or internal to the crRNA. Alternative backbone structures can also be introduced.

In silico designed crRNA sequences can be provided to a commercial manufacturer for synthesis.

Modified crRNAs can be evaluated for their ability to support binding by individual Cascade subunit proteins (i.e., Cas6, Cas5, etc.), or to support complete formation of the Cascade protein complex, or to support formation of the Cascade complex and modification of a double-stranded DNA target sequence through recruitment of a nuclease (e.g., Cas3). crRNA binding to individual Cascade subunit proteins and Cascade protein complex assembly can be evaluated by nano-ESI mass spectrometry in a manner similar to Jore, M., et al., Nature Structural & Molecular Biology 18:529-536 (2011). Biochemical characterization of crRNA and Cascade protein complex modification of a double-stranded DNA target sequence through recruitment of a nuclease can be carried out in a manner similar to those described in Examples 6 and 7. Modified crRNA that are capable of supporting formation of the Cascade complex and modification of a double-stranded DNA target sequence through recruitment of a nuclease can be validated for activity in cells using the method described in Example 8.

Example 17

Screening of Cascade Complex Guides Comprising DNA Target Binding Sequences

This Example illustrates the use of Type I CRISPR proteins and Type I guide crRNAs of the present invention to modify DNA target sequences present in human genomic DNA (gDNA) and to measure the level of cleavage activity at those sites.

Target sites (DNA target sequences) can be first selected from genomic DNA. Type I guide crRNAs can be designed to target the selected sequences. Assays (e.g., as described in Example 7) can be performed to determine the level of DNA target sequence cleavage.

A. Selecting DNA Target Sequences from Genomic DNA

PAM sequences (e.g., ATG) for a Cascade protein complex (e.g., *E. coli* Type I-E Cascade) can be identified within the selected genomic region.

One or more Cascade DNA target sequences (e.g., 32 nucleotides in length) that are 3' adjacent to a ATG PAM sequence can be identified.

Criteria for selection of nucleic acid target sequences can include, but are not limited to, the following: homology to other regions in the genome; percent G-C content; melting temperature; presences of homopolymer within the spacer; distance between the two sequences; and other criteria known to one skilled in the art.

A DNA target binding sequence that hybridizes to the Cascade DNA target sequence can be incorporated into a guide crRNAs. The nucleic acid sequence of a guide crRNA construct is typically provided to and synthesized by a commercial manufacturer.

A guide crRNA, as described herein, can be used with cognate Type I Cascade protein complex to form crRNA/Cascade protein complexes.

B. Determination of Cleavage Percentages and Specificity

In vitro cleavage percentages and specificity (i.e., the amount of off-target binding) related to a guide crRNA can be determined, for example, using the cleavage assays described in Example 7, and compared as follows:

(1) If only a single DNA target sequences is identified or selected for a guide crRNA, the cleavage percentage and specificity for each of the DNA target sequences can be determined. If so desired, cleavage percentage and/or specificity can be altered in further experiments using methods including, but not limited to, modifying the guide crRNA, or introducing effector proteins/effector protein-binding sequences to modify the guide crRNA or the Cascade subunit proteins, or ligand/ligand-binding moieties to modify the guide crRNA or the Cascade subunit proteins.

(2) If multiple DNA target sequences are identified or selected for guide crRNAs, the percentage cleavage data and site-specificity data obtained from the cleavage assays can be compared between different DNAs comprising the target binding sequence to identify the DNA target sequences having the desired cleavage percentage and specificity. Cleavage percentage data and specificity data provide criteria on which to base choices for a variety of applications. For example, in some situations the activity of the guide crRNA may be the most important factor. In other situations, the specificity of the cleavage site may be relatively more important than the cleavage percentage. If so desired, cleavage percentage and/or specificity can be altered in further experiments using methods including, but not limited to, modifying the guide crRNA, introducing effector proteins/effector protein-binding sequences to modify the guide crRNA or the Cascade subunit proteins, or ligand/ligand-binding moieties to modify the guide crRNA or the Cascade subunit proteins.

Alternatively, or in addition to the in vitro analysis, in-cell cleavage percentages and specificities of guide crRNAs can be obtained using, for example, the method described in Example 8, and compared as follows:

(1) If only a single DNA target sequences is identified or selected for a guide crRNA, the cleavage percentage and specificity for each of the DNA target sequences can be determined. If so desired, cleavage percentage and/or specificity can be altered in further experiments using methods including, but not limited to, modifying the guide crRNA, or introducing effector proteins/effector protein-binding sequences to modify the guide crRNA or the Cascade subunit proteins, or ligand/ligand-binding moieties to modify the guide crRNA or the Cascade subunit proteins.

(2) If multiple DNA target sequences are identified or selected for guide crRNAs, the percentage cleavage data and site-specificity data obtained from the cleavage assays can be compared between different DNAs comprising the target binding sequence to identify the DNA target sequences having the desired cleavage percentage and specificity. Cleavage percentage data and specificity data provide criteria on which to base choices for a variety of applications. For example, in some situations the activity of the guide crRNA may be the most important factor. In other situations, the specificity of the cleavage site may be relatively more important than the cleavage percentage. If so desired, cleavage percentage and/or specificity can be altered in further experiments using methods including, but not limited to, modifying the guide crRNA, introducing effector proteins/effector protein-binding sequences to modify the guide crRNA or the Cascade subunit proteins, or ligand/ligand-binding moieties to modify the guide crRNA or the Cascade subunit proteins.

Example 18

Varying FokI-Cas8 Linker Composition and Interspacer Distance for Efficient FokI-Cascade Complex Genome Editing This Example illustrates the design and testing of multiple fusion proteins comprising FokI-Cas8 and linker polypeptides of various lengths, as well as the effect of varying interspacer distances for efficient genome editing.

A. Production of a Vector Encoding *E. coli* Type I-E Cascade Complex Components Comprising FokI Fusion Proteins to be Transfected into Target Cells Minimal CRISPR arrays were designed to target a set of loci in the human genome at or near two different genes: ADAMTSL1 and PCSK9. Interspacer distances ranged from 14-60 bp, in increments of 2 bp. Four targets were designed for each interspacer distance. Targets were flanked by either AAG or ATG PAM sequences. Dual guides containing "repeat-spacer-repeat-spacer-repeat" sequences were cloned as described in Example 9 with SEQ ID NO:454. SEQ ID NO:625 through SEQ ID NO:816 provide the sequences for the full set of oligonucleotide sequences used to generate the minimal CRISPR arrays.

FokI-Cascade RNP subunit protein component-encoding genes were cloned into vectors comprising: CMV promoters to enable delivery and expression in mammalian cells; cas genes linked via 2A viral peptide "ribosome-skipping" sequences; a fusion protein comprising FokI and Cas8 connected with a 30-aa linker (SEQ ID NO:455 from Example 3). Additional linker polypeptide sequences of varying length and amino acid composition were designed and used to connect FokI to the Cas8 protein in these vectors. The additional linker polypeptide sequences are listed in Table 38.

TABLE 38

Amino Acid Linker Sequences

| SEQ ID NO: | Linker length (amino acids) | Amino acid sequence |
|---|---|---|
| SEQ ID NO:817 | 5 | GGGGS |
| SEQ ID NO:818 | 8 | TGPGAAAR |
| SEQ ID NO:819 | 10 | GGSGSSGGSG |
| SEQ ID NO:820 | 15 | GGSGSSGGSGSSGGS |
| SEQ ID NO:821 | 17 | ADPTNRAKGLEAVSVAS |
| SEQ ID NO:822 | 20 | SGSETPGTSESATPESGGSG |
| SEQ ID NO:433 | 30 | SGSETPGTSESATPESGGSGSSG GSGSSGG |
| SEQ ID NO:823 | 40 | SGSETPGTSESATPESGGSGSSG GSGSSGGSGSSGGSGSS |

TABLE 38-continued

Amino Acid Linker Sequences

| SEQ ID NO: | Linker length (amino acids) | Amino acid sequence |
|---|---|---|
| SEQ ID NO:824 | 50 | SGSETPGTSESATPESGGSGSSG GSGSSGGGSGSSGGSGSSGGSGS SGGSG |

B. Transfection of Vectors Encoding FokI-Cascade RNP Complex Components

Transfection conditions were essentially as described in Example 8 with the following modifications. Prior to nucleofection, 5 µl of plasmid vector solution was transferred to individual wells of a 96-well plate. Each well contained 2.4 µg of plasmid encoding FokI-Cascade RNP complex subunit protein components and ~1-2 µg of plasmid encoding the minimal CRISPR array.

C. Deep Sequencing of gDNA from Transfected Cells

Deep sequencing was performed essentially as described in Example 8 with the following modifications. Instead of primers Y and Z from Table 31 of Example 8, the target-specific primers were SEQ ID NO:825 to SEQ ID NO:1016.

D. Deep Sequencing Data Analysis

Deep sequencing data analysis was performed essentially as described in Example 8. FIG. 32A and FIG. 32B present the results of the data analysis. In FIG. 32A and FIG. 32B, percent genome editing is shown as a function of FokI-Cas8 linker type and interspacer distance (n=1); grey scale vertical bar to the right is percentage of indels. An initial analysis of the data showed genome editing was highest with FokI-Cas8 linkers of 17 and 20 amino acids (SEQ ID NO:821 and SEQ ID NO:822, respectively) and with interspacer distances of ~26 bp and ~30-32 bp. The data was reprocessed and samples with less than a thousand sequences reads were removed as they may contain inflated editing values due to low coverage (sites were only retained if all the associated samples contained >1000 reads). This data, presented in FIG. 32A and FIG. 32B, showed that genome editing was highest with FokI-Cas8 linkers of 17 and 20 amino acids (SEQ ID NO:821 and SEQ ID NO:822, respectively) and with interspacer distances of ~30-32 bp. Thus, efficient genome editing using Type I CRISPR-Cas complexes comprising FokI-Cas8 fusion proteins was achieved by varying the interspacer distance and the linker polypeptide length of the FokI-Cas8 fusion protein. The amino acid composition of the linker polypeptides is discussed herein.

Example 19

Identifying Cascade Homologs that Enable High-efficiency Genome Editing

This Example illustrates the design and testing of multiple homolog Cascade complexes to evaluate the efficiency of genome editing.

A. Identification of Sites for Testing with Homolog Cascade Complexes

A panel of sites was identified for testing additional homolog Cascade complexes: Specifically, minimal CRISPR arrays were designed to target a set of loci in the human genome with 30 bp interspacer distances and that were flanked by either AAG or ATG PAM sequences. Dual-guide polynucleotides containing "repeat-spacer-repeat-spacer-repeat" sequences were cloned following the method described in Example 9 with SEQ ID NO:454. The full set of oligonucleotide sequences used to generate the minimal CRISPR arrays are presented as SEQ ID NO:1017 to SEQ ID NO:1130 (Hsa33F, SEQ ID NO:1017, and Hsa33R, SEQ ID NO:1074, exemplify one pair). A positive control dual-guide targeting the TRAC locus was included (SEQ ID NO:454).

FokI-Cascade RNP subunit protein component-encoding genes were cloned into vectors comprising: CMV promoters to enable delivery and expression in mammalian cells; cas genes linked via 2A viral peptide "ribosome-skipping" sequences; a fusion protein comprising FokI and Cas8 connected with a 30-aa linker (SEQ ID NO:455 from Example 3).

B. Transfection of Vectors Encoding FokI-Cascade RNP Complex Components

Transfection conditions were performed essentially as described in Example 8 with the following modifications. Prior to nucleofection, 5 µl of plasmid vector solution was transferred to individual wells of a 96-well plate. Each well contained 3 µg of plasmid encoding FokI-Cascade RNP subunit protein components and 0.3 µg of plasmid encoding the minimal CRISPR array.

C. Deep Sequencing of gDNA from Transfected Cells

Deep sequencing was performed essentially as described in Example 8 with the following modifications. Instead of primers Y and Z from Table 31 of Example 8, the target-specific primers used in this Example were SEQ ID NO:1131 to SEQ ID NO:1244.

D. Deep Sequencing Data Analysis

Figure 33:
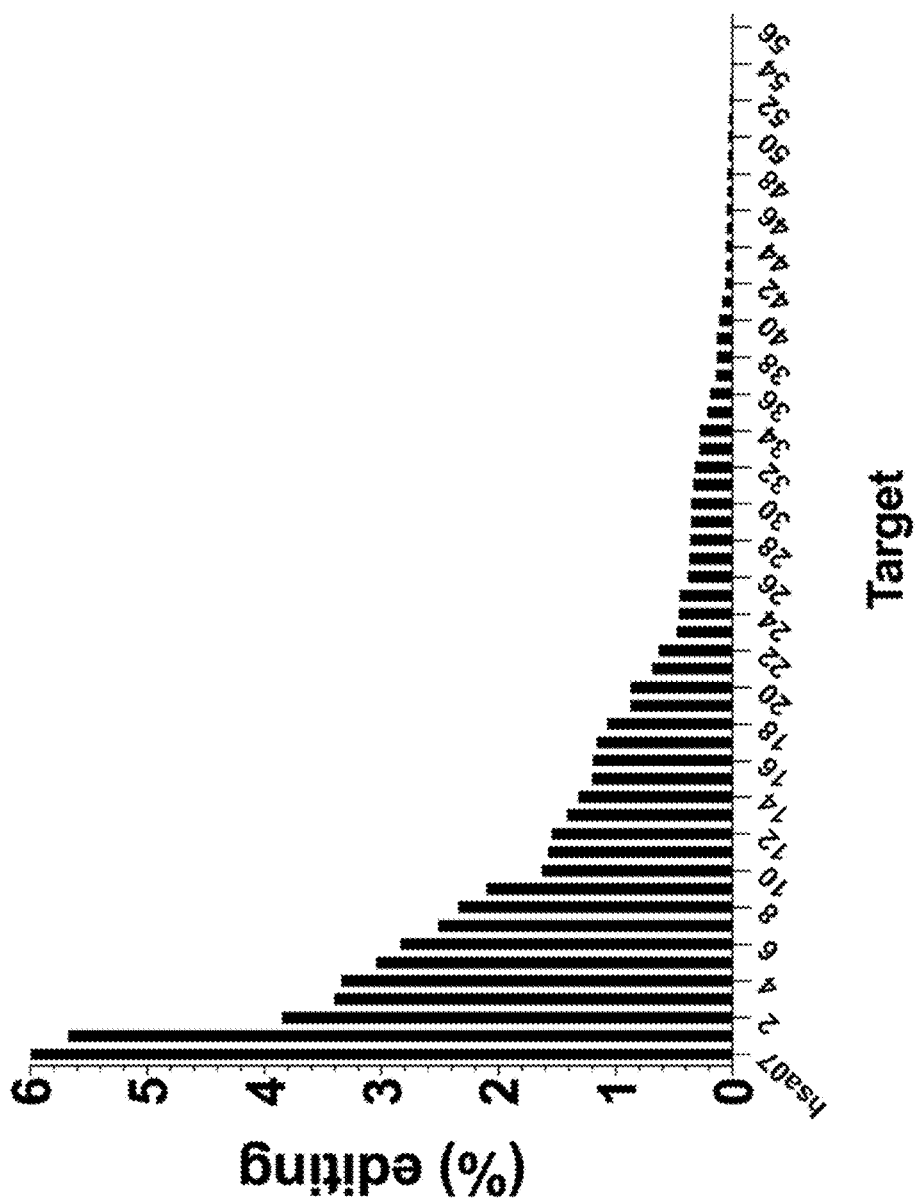

Deep sequencing data analysis was performed essentially as described in Example 8. FIG. 33 present the results of the data analysis. In FIG. 33, percent genome editing is plotted against 58 test sites (oligonucleotide sequences used to generate these minimal CRISPR arrays are discussed above) in addition to target Hsa07 from Example 8 (n=3). As is shown in FIG. 33, editing ranged from ~6% to below the limit of detection. From these data, a panel of eight sites (Hsa07 as well as targets 1, 3-5, 10, 13, and 16 corresponding to the following targets Hsa37, Hsa43, Hsa46, Hsa60, Hsa77, Hsa88, and Hsa126) with AAG PAMs were selected for testing homolog Cascade complexes for genome editing.

E. Identification of Homolog Cascade Complexes to Test with FokI Nuclease for Genome Editing Cas8 protein sequences from different Type I systems were used as queries for psi-BLASTp to generate phylogenetic trees for homolog selection. Specifically, Cas8 from *Fusobacterium nucleatum* (WP_008798978.1) was used for Type I-B, Cas8 from *Bacillus halodurans* (WP_010896519.1) was used for Type I-C, Cas8 from *E. coli* (WP_001050401.1) was used for Type I-E, Cas8 from *Pseudomonas aeruginosa* (WP_003139224.1) was used for Type I-F, and Cas5 from *Shewanella putrefaciens* (WP_011919226.1) was used for Type I-Fv2.

Next, psi-BLASTp was iterated multiple times until thousands of homologs were identified for each Type I system. From this information, phylogenetic trees were built using the interactive Tree of Life online software (iTOL, accessible at itol.embl.de/login.cgi). The trees were visually inspected after auto-collapsing clades using variable branch lengths.

Lists of organisms falling within major clades were then outputted and manually inspected for selection. In this step, priority was placed on selecting homologs that sampled from different regions of the phylogenetic tree, both for the 12 homologs within the Type I-E as well as 2-3 representative homologs for Types I-B, I-C, I-F, and I-Fv2. cas8 and cas5 candidates, based on the above phylogenetic analysis, were inputted into NCBI, and the genomic context within the endogenous host bacterium was visually inspected within NCBI's genome graphics browser. Cascade homologs were selected only if (1) they were found in organisms that grow at 37° C.; (2) their cas gene operons were intact and had all the expected Cascade subunit protein encoding genes, a cas3 gene, and intact acquisition genes (i.e., cas1 and cas2); (3) their cas gene operon was flanked by one or more CRISPR arrays; and (4) their CRISPR arrays contained >10 spacers. For some homologs, the CRISP-Rfinder program (crispr.i2bc.paris-saclay.fr/Server/) was used to identify putative PAM sequences. Based on the above criteria, the 22 homolog Cascade complexes shown in Table 39 were selected.

TABLE 39

Homolog Cascade Complexes

| SEQ ID NO: | Cascade homolog organism | PAM | Spacer length | Type |
|---|---|---|---|---|
| SEQ ID NO:1245 | *Oceanicola* sp. HL-35 | AAG | 32 | I-E |
| SEQ ID NO:1246 | *Pseudomonas* sp. S-6-2 | AAG | 32 | I-E |
| SEQ ID NO:1247 | *Salmonella enterica* subsp. *enterica* serovar Muenster strain | AAG | 32 | I-E |
| SEQ ID NO:1248 | *Atlantibacter hermannii* NBRC 105704 | AAG | 32 | I-E |
| SEQ ID NO:1249 | *Geothermobacter* sp. EPR-M | AAG | 32 | I-E |
| SEQ ID NO:1250 | *Methylocaldum* sp. 14B | AAG | 32 | I-E |
| SEQ ID NO:1251 | *Methanocella arvoryzae* MRE50 | AAG | 32 | I-E |
| SEQ ID NO:1252 | *Pseudomonas aeruginosa* DHS01 | AAG | 32 | I-E |
| SEQ ID NO:1253 | *Lachnospiraceae bacterium* KH1T2 | GAA | 35 | I-E |
| SEQ ID NO:1254 | *Klebsiella pneumoniae* strain VRCO0172 | GAA | 33 | I-E |
| SEQ ID NO:1255 | *Streptococcus thermophilus* strain ND07 | GAA | 33 | I-E |
| SEQ ID NO:1256 | *Streptomyces* sp. S4 | GAA | 33 | I-E |
| SEQ ID NO:1257 | *Campylobacter fetus* subsp. *testudinum* Sp3 | TCA | 36 | I-B |
| SEQ ID NO:1258 | *Odoribacter splanchnicus* DSM 20712 | TCA | 36 | I-B |
| SEQ ID NO:1259 | *Bacillus halodurans* C-125 | TTC | 34 | I-C |
| SEQ ID NO:1260 | *Desulfovibrio vulgaris* RCH1 plasmid pDEVAL01 | TTC | 34 | I-C |
| SEQ ID NO:1261 | *Geobacillus thermocatenulatus* strain KCTC 3921 | TTC | 35 | I-C |
| SEQ ID NO:1262 | *Vibrio cholerae* strain L15 L15_contig8 | CC | 32 | I-F |
| SEQ ID NO:1263 | *Pseudomonas aeruginosa* UCBPP-PA14 | CC | 32 | I-F |
| SEQ ID NO:1264 | *Shewanella putrefaciens* CN-32 | CC | 32 | I-Fv2 |
| SEQ ID NO:1265 | *Acinetobacter* sp. 869535 | CC | 32 | I-Fv2 |
| SEQ ID NO:1266 | *Vibrio cholerae* HE48 vcoHE48.contig.11 | CC | 32 | I-Fv2 |

F. Production of Vectors Encoding FokI-Cascade RNP Components from 22 Distinct Species for Transfection into Target Cells Sequences for each cas gene from each homolog were synthesized as part of a polycistronic construct that included a fusion protein comprising FokI nuclease and Cas8. For each Type I-E Cascade complex homolog, a set of ~7-8 guides targeting loci with the appropriate PAM sequences were generated. For each Type I-B, I-C, I-F, and I-Fv2 Cascade homolog, a set of ~2-7 guides targeting loci with appropriate PAM sequences were generated. Each Cascade complex homolog system required unique repeat sequences to process their cognate guide (SEQ ID NO:1267 to SEQ ID NO:1288). Dual guides containing "repeat-spacer-repeat-spacer-repeat" sequences were cloned using the method described in Example 9 for SEQ ID NO:454. Oligonucleotides were phosphorylated on the 5' end and appended with overhang sequences to enable cloning into plasmid vectors with the appropriate repeat sequences. The full set of oligonucleotide sequences used to generate the minimal CRISPR arrays for the 22 Cascade complex homologs are presented as (SEQ ID NO:1289 to SEQ ID NO:1400).

FokI-Cascade RNP subunit protein component-encoding genes were cloned into vectors comprising: CMV promoters to enable delivery and expression in mammalian cells; cas genes linked via 2A viral peptide "ribosome-skipping" sequences; a fusion protein comprising FokI and Cas8 connected with a 30-aa linker G. Transfection of Plasmids Encoding FokI-Cascade Complex RNPs Transfection conditions were essentially as described in Example 8 with the following modifications. Prior to nucleofection, 5 µl of plasmid vector solution was transferred to individual wells of a 96-well plate. Each well contained 1.5 µg of plasmid encoding FokI-Cascade RNP subunit protein components and ~0.5-1.5 µs of plasmid encoding the minimal CRISPR array. Experiments were performed in triplicate and included FokI-Cascade RNP complexes from *E. coli* (SEQ ID NO:455) targeted to eight sites (Hsa07 from Example 8 and Hsa37, Hsa43, Hsa46, Hsa60, Hsa77, Hsa88, Hsa126 from section D of this Example) as positive controls. As previously described, the following oligonucleotides were used to generate the minimal CRISPR arrays used with the *E. coli* positive control: Hsa37 (SEQ ID NO:1019; SEQ ID NO:1076), Hsa43 (SEQ ID NO:1024; SEQ ID NO:1081), Hsa46 (SEQ ID NO:1027; SEQ ID NO:1084), Hsa60 (SEQ ID NO:1037; SEQ ID NO:1094), Hsa77 (SEQ ID NO:1045; SEQ ID NO:1102), Hsa88 (SEQ ID NO:1050; SEQ ID NO:1107), Hsa126 (SEQ ID NO:1072; SEQ ID NO:1129).

H. Deep Sequencing of gDNA from Transfected Cells

Deep sequencing was performed essentially as described in Example 8 with the following modifications. Instead of primers Y and Z from Table 31 of Example 8, the target-specific primers used in this Example were SEQ ID NO:1401 to SEQ ID NO:1512. For both Type I-E RNP complexes and Type I-B, I-C, I-F, and I-Fv2 RNP complexes, control samples comprising *E. coli* Type I-E Cascade were included for comparison and sequenced with target-specific primers corresponding to targets Hsa07 from Example 8 and Hsa37, Hsa43, Hsa46, Hsa60, Hsa77, Hsa88, Hsa126 from this Example. More specifically, the following target-specific amplification primers were used for these targets: Hsa37 (SEQ ID NO:1133; SEQ ID NO:1190), Hsa43 (SEQ ID NO:1138; SEQ ID NO:1195), Hsa46 (SEQ ID NO:1141; SEQ ID NO:1198), Hsa60 (SEQ ID NO:1151; SEQ ID NO:1208), Hsa77 (SEQ ID NO:1159; SEQ ID NO:1216), Hsa88 (SEQ ID NO:1164; SEQ ID NO:1221), Hsa126 (SEQ ID NO:1186; SEQ ID NO:1243).

I. Deep Sequencing Data Analysis

Figures 34A, 34B:
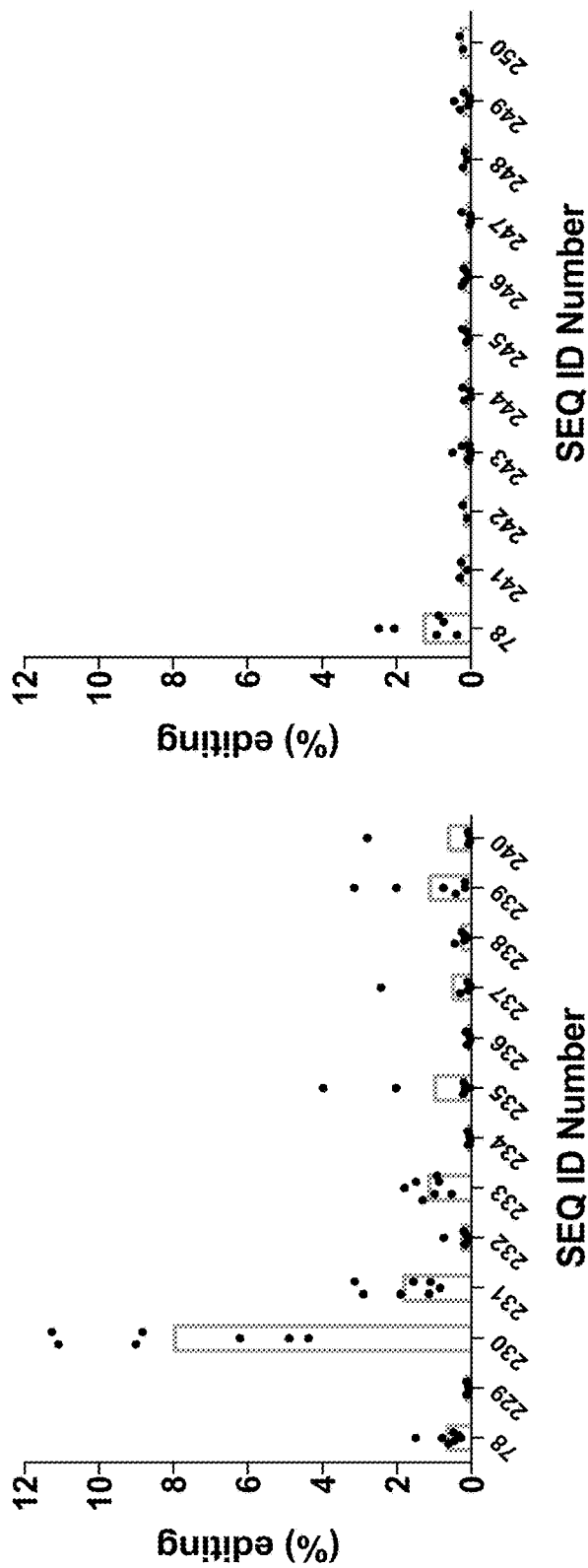

Deep sequencing data analysis was performed essentially as described in Example 8. FIG. 34A and FIG. 34B show results from these experiments. Editing was observed with many of the Type I-E FokI-Cascade homologs (FIG. 34A). The highest editing was observed with the variant from *Pseudomonas* sp. S-6-2, while other homologs (i.e., *Salmo-* nella enterica, *Geothermobacter* sp. EPR-M, *Methanocella arvoryzae* MRE50, and *S. thermophilus* (strain ND07)) showed editing approximately equivalent to *E. coli*. Editing with FokI-Cascade RNPs derived from Types I-B, I-C, I-F, and I-Fv2 was not observed and therefore may be below the limit of detection (FIG. 34B).

Example 20

Varying FokI-Cas8 Linker Length and Interspacer Distances in *Pseudomonas* sp S-6-2 for Efficient Genome Editing This Example illustrates the design and testing of multiple fusion proteins comprising FokI-Cas8 and linker polypeptides of various lengths, as well as the effect of varying interspacer distances for efficient genome editing with *Pseudomonas* sp S-6-2 Type I-E CRISPR-Cas systems.

A. Production of a Vector Encoding FolkI-Cascade RNP Components to be Transfected into Target Cells Minimal CRISPR arrays were designed to target a set of loci in the human genome. Interspacer distances ranged from 23-34 bp, in increments of 1 bp. Eight targets were designed for each of the interspacer distances, and targets were flanked by AAG PAM sequences. Dual guides were generated with PCR-based assembly using three oligonucleotides (SEQ ID NO:1513 to SEQ ID NO:1515) and a unique primer encoding a "repeat-spacer-repeat-spacer-repeat" sequence to enable FolkI-Cascade targeting. The full set of unique oligonucleotide sequences to generate the minimal CRISPR arrays were SEQ ID NO:1516 to SEQ ID NO:1704. PCR-assembled guides were purified and concentrated using SPRIselect® beads (Beckman Coulter, Pasadena, Calif.) essentially according to the manufacturer's instructions.

FokI-Cascade RNP subunit protein component-encoding genes were cloned into vectors comprising: CMV promoters to enable delivery and expression in mammalian cells, cas genes linked via 2A "ribosome-skipping" sequences, and FolkI attached to Cas8 with a 30-aa linker (SEQ ID NO:1748). Additional linker polypeptide sequences of varying length were designed and used to connect FolkI to the Cas8 protein to form fusion proteins. The linker polypeptide sequences are listed in Table 40.

TABLE 40

Amino Acid Linker Sequences

| Linker length (amino acids) | Amino acid sequence | SEQ ID NO: |
|---|---|---|
| 17 | ADPTNRAKGLEAVSVAS | SEQ ID NO:821 |
| 20 | SGSETPGTSESATPESGGSG | SEQ ID NO:822 |

B. Transfection of Vectors Encoding FolkI-Cascade RNP Complex Components

Transfection conditions were performed essentially as described in Example 8 except for with the following modifications. Prior to nucleofection, 5 µl of plasmid vector solution was transferred to individual wells of a 96-well plate. Each well contained 5 µg of plasmid encoding FolkI-Cascade RNP protein components and ~0.1-0.5 µg of linear PCR product encoding the minimal CRISPR array.

C. Deep Sequencing of gDNA from Transfected Cells

Deep sequencing was performed essentially as described in Example 8. Instead of primers Y and Z from Table 31 of Example 8, the target-specific primers were SEQ ID NO:1705 to SEQ ID NO:1803.

D. Deep sequencing data analysis

Figure 35:
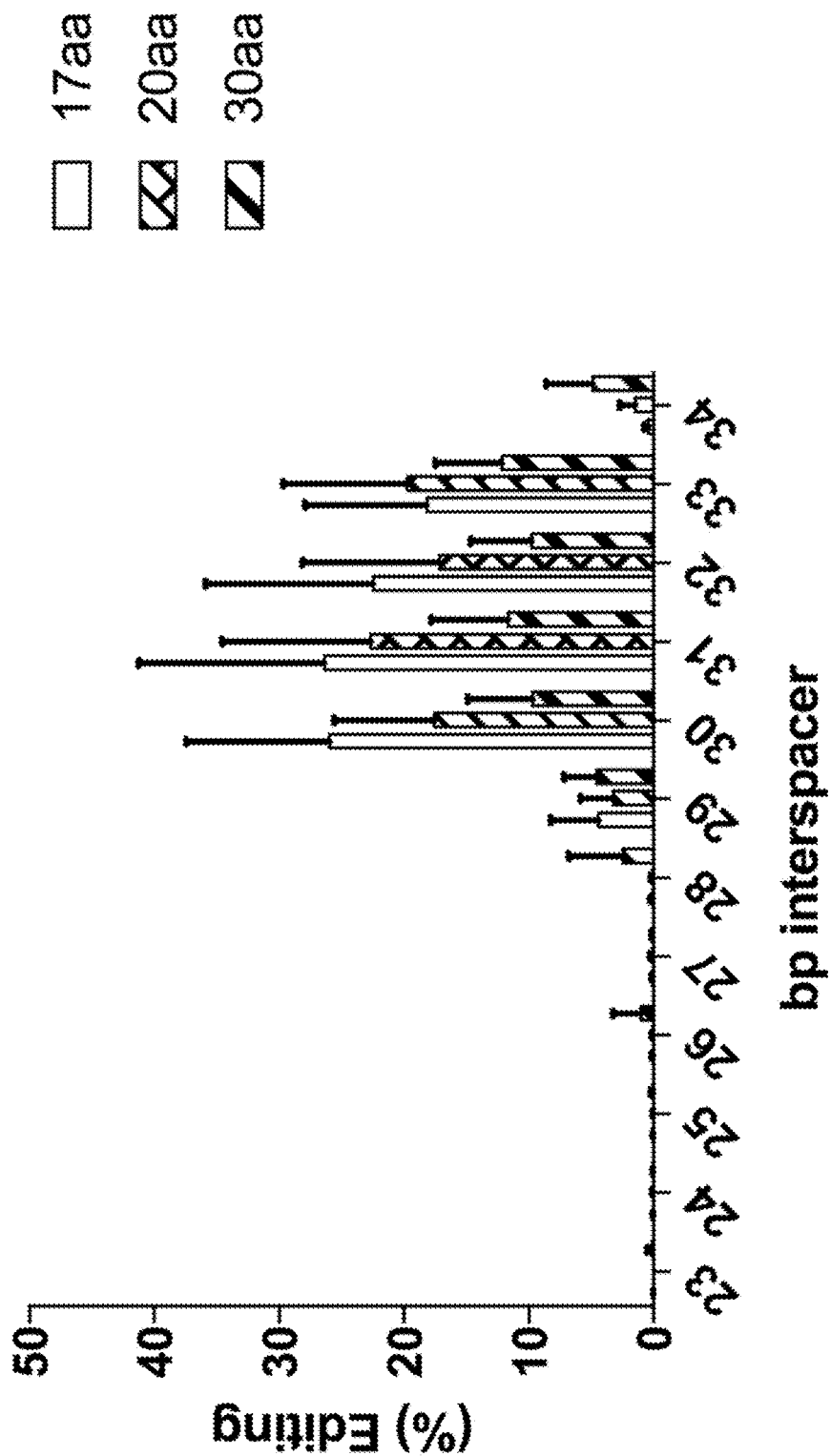

Deep sequencing data analysis was performed essentially as described in Example 8. FIG. 35 shows genome editing at 95 sites (n=1). Editing ranged from ~50% (FIG. 35 shows the mean+/−1 standard deviation) to below the limit of detection, and was related to the interspacer distance and linker polypeptide length. The amino acid composition of the linker polypeptides is discussed herein. Interspacer distances of ~30-33 bp and linker polypeptide lengths of 17 and 20 amino acids provided very efficient editing.

Example 21

Utilizing Cas3-FokI and FolkI-Cas8 to Enable FolkI-Cascade Genome Editing

This Example illustrates the use of Cas3-FokI and FolkI-Cascade to induce dimerization of FokI to generate a double-strand break at a locus in the human genome (see e.g., FIG. 17A, FIG. 17B, and FIG. 17C). More specifically, this Example details the design and testing of multiple Cas3-FokI linker compositions and lengths and FokI-Cas8 linker compositions and lengths for affecting genome editing efficiency.

A. Production of a Vectors Encoding FokI-Cas3 and FolkI-Cascade RNP Components to be Transfected into Target Cells Minimal CRISPR arrays are designed to target three distinct sites flanked by AAG PAMs in the human genome. Sites are selected that were previously shown to support interspacer editing with *E. coli* FokI-Cascade dimers directed by dual-guides and are therefore known to be permissive for FolkI-Cascade binding (e.g., Hsa37, Hsa43, and Hsa46).

The FolkI-Cascade systems described in the Examples above used two FokI Cascade complexes (see e.g., FIG. 16A, FIG. 16B, and FIG. 16C); accordingly, dual-guides comprising a first guide sequence specifying a first nucleic acid target site and a second guide sequence specifying a second nucleic acid target site can be used. Because the Cas3-FokI-FokI-Cascade system only requires a single PAM, a guide comprising "repeat-spacer-repeat" should be sufficient to facilitate binding of the functional Cascade complex to a nucleic acid target site. A dual-guide containing "repeat-spacer-repeat-spacer-repeats" can also be used but, typically in this embodiment, the two spacer sequences direct binding of the Cascade complex to the same nucleic acid target sequence; that is, the two spacers can have the same sequence. The guides are cloned essentially as described in Example 9 with SEQ ID No:454. The following annealed oligonucleotides are used for generation of the minimal CRISPR arrays: Hsa37 (SEQ ID NO:1019; SEQ ID NO:1076), Hsa43 (SEQ ID NO:1024; SEQ ID NO:1081), and Hsa46 (SEQ ID NO:1027; SEQ ID NO:1084).

As described in Example 9, FolkI-Cascade RNP protein component-encoding genes are cloned into plasmid vectors containing CMV promoters to enable delivery and expression in mammalian cells. cas genes are linked via 2A "ribosome-skipping" sequences. Furthermore, FokI is fused to Cas8 with a 30-aa linker (SEQ ID NO:455 from Example 3). Additional linkers sequences of varying length and composition are designed and used to connect FokI to the Cas8 protein. Example of such sequences are listed in Table 41.

Cas3 protein from *E. coli* is fused with FolkI on the C-terminus using a 30-aa linker. This fusion is further modified with an NLS sequence on the N-terminus (SEQ ID NO:1806). Additional linkers sequences of varying length and composition are designed and used to connect FokI to the Cas3 protein (Table 41 and SEQ ID NO:1804 to SEQ ID NO:1807).

Additional Cas3-FokI fusion constructs are generated wherein the helicase or nuclease activity of the Cas3 protein is inactivated (SEQ ID NO:1808 to SEQ ID NO:1815). Helicase and nuclease activities are impaired by making D452A and D75A modifications, respectively, of the Cas3 protein (Mulepati, S., et al., J. Biol. Chem. 288(31):22184-22192 (2013)).

TABLE 41

Amino Acid Linker Sequences

| Linker length (amino acids) | Amino acid sequence | SEQ ID NO: |
|---|---|---|
| 5 | GGGGS | SEQ ID NO:817 |
| 10 | GGSGSSGGSG | SEQ ID NO:819 |
| 17 | ADPTNRAKGLEAVSVAS | SEQ ID NO:821 |
| 20 | SGSETPGTSESATPESGGSG | SEQ ID NO:822 |
| 40 | SGSETPGTSESATPESGGSG SSGGSGSSGGSGSSGGSGSS | SEQ ID NO:823 |

B. Transfection of Plasmids Encoding FokI-Cascade Complex RNPs

Transfection conditions are performed as described in Example 8 with the following modifications. Prior to nucleofection, 5 µl of plasmid vector solution are transferred to individual wells of a 96-well plate. Each well comprises the following three components: 3 µg of a plasmid encoding a set of FokI-Cascade RNP protein components, 3 µg of a plasmid encoding a Cas3-FokI, and 0.5 µg of a plasmid encoding a minimal CRISPR array. The 96-well plate is set up as a matrix to provide all combinations of the three components.

C. Deep Sequencing of gDNA from Transfected Cells

Deep sequencing is performed as described in Example 8 with the following modifications. Instead of primers Y and Z from Table 4 of Example 8, the target-specific primers used in this Example are as follows: SEQ ID NO:1133 and SEQ ID NO:1190 (Hsa37 target site), SEQ ID NO:1138 and SEQ ID NO:1195 (Hsa43 target site), and SEQ ID NO:1141 and SEQ ID NO:1198 (Hsa46 target site).

D. Deep Sequencing Data Analysis

Deep sequencing data analysis is performed as described in Example 8 with the exception that indels ~1 bp to −25 bp upstream of the FolkI-Cascade binding site PAM sequence are tallied. In this manner, the combinations of FokI-Cas8 linker sequences, Cas3-FokI linker sequences, and Cas3 variants that support the most efficient editing can be determined.

As is apparent to one of skill in the art, various modification and variations of the above embodiments can be made without departing from the spirit and scope of this invention. Such modifications and variations are within the scope of this invention.

---

SEQUENCE LISTING (1815 sequences)

SEQ ID NO: 1 - DNA, 1509 bp, Escherichia coli K-12 MG1655
  misc_feature (1)..(1509): Cas8
atgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctga

SEQ ID NO: 2 - DNA, 483 bp, Escherichia coli K-12 MG1655
  misc_feature (1)..(483): Cse2
atggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaa

SEQ ID NO: 3 - DNA, 1092 bp, Escherichia coli K-12 MG1655
  misc_feature (1)..(1092): Cas7
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtga

SEQ ID NO: 4 - DNA, 675 bp, Escherichia coli K-12 MG1655
  misc_feature (1)..(675): Cas5
atgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaa

SEQ ID NO: 5 - DNA, 600 bp, Escherichia coli K-12 MG1655
  misc_feature (1)..(600): Cas6
atgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtga

SEQ ID NO: 6 - DNA, 1509 bp, Escherichia coli K-12 MG1655
  misc_feature (1)..(1509): Cas8
atgaatctgctgattgataattggattccggttcgtccgcgtaatggtggtaaagttcagattattaatctgcagagcctgtattgtagccgtgatcagtggcgtctgagcctgccgcgtgatgatatggaactggcagcactggcactgctggtttgtattggtcagattattgcaccggcaaaagatgatgttgaatttcgccatcgtattatgaatccgctgaccgaagatgaatttcagcagctgattgccccgtggattgatatgttttatctgaatcatgcagaacatccgtttatgcagaccaaaggtgttaaagcaaatgatgttaccccgatggaaaaactgctggccggtgttagcggtgcaaccaattgtgcatttgttaatcagccgggtcagggtgaagcactgtgtggtggttgtaccgcaattgcactgtttaatcaggcgaatcaggccccgggttttggtggtggttttaaaagcggtctgcgtggtggtacaccggttaccacctttgttcgtggtattgatctgcgtagcaccgttctgctgaatgttctgaccctgccgcgtctgcagaaacagtttccgaatgaaagccataccgaaaatcagccgacctggattaaaccgattaaaagcaatgaaagcattccggcaagcagcattggttttgtgcgtggtctgttttggcagccggcacatattgaactgtgtgatccgattggtattggtaaatgtagctgttgtggtcaggaaagcaatctgcgttataccggctttctgaaagagaaatttacctttaccgttaatggtctgtggccgcatccgcatagcccgtgtctggttaccgtgaaaaaaggtgaagttgaagaaaaatttctggcatttaccaccagcgcaccgagctggacccagattagccgtgttgttgttgataaaattattcagaatgaaaatggcaatcgtgttgcagcagttgtgaatcagtttcgtaatattgcgccgcagagcccgctggaactaattatgggtggttatcgtaataatcaggcaagcattctggaacgccgtcatgatgttctgatgtttaatcagggttggcagcagtatggtaatgtgattaatgaaattgtgaccgttggtctgggctataaaaccgcactgcgtaaagcgctgtatacctttgccgaaggctttaaaaacaaagattttaaaggtgcaggcgttagcgttcatgaaaccgccgaacgtcatttttatcgtcagagcgaactgctgattccggatgtgctggcaaatgttaattttagccaggcagatgaagttattgcagatctgcgcgataaactgcatcagctgtgtgaaatgctgtttaatcagagcgttgcaccgtatgcacatcatccgaaactgattagcaccctggccctggcacgtgcaaccctgtataaacatctgcgtgaactgaaaccgcagggtggtccgagcaatggttaa

SEQ ID NO: 7 - DNA, 483 bp, Escherichia coli K-12 MG1655
  misc_feature (1)..(483): Cse2
atggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaa

SEQ ID NO: 8 - DNA, 1092 bp, Escherichia coli K-12 MG1655
  misc_feature (1)..(1092): Cas7
atgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataa

SEQ ID NO: 9 - DNA, 675 bp, Escherichia coli K-12 MG1655
  misc_feature (1)..(675): Cas5
atgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaa

SEQ ID NO: 10 - DNA, 600 bp, Escherichia coli K-12 MG1655
  misc_feature (1)..(600): Cas6
atgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaa

SEQ ID NO: 11 - DNA, 1509 bp, Escherichia coli K-12 MG1655
  misc_feature (1)..(1509): Cas8
atgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaa

SEQ ID NO: 12 - DNA, 483 bp, Escherichia coli K-12 MG1655
  misc_feature (1)..(483): Cse2
atggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaa

SEQ ID NO: 13 - DNA, 1092 bp, Escherichia coli K-12 MG1655
  misc_feature (1)..(1092): Cas7
atgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaa

SEQ ID NO: 14 - DNA, 675 bp, Escherichia coli K-12 MG1655
  misc_feature (1)..(675): Cas5
atgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaa

SEQ ID NO: 15 - DNA, 600 bp, Escherichia coli K-12 MG1655
  misc_feature (1)..(600): Cas6
atgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaa

SEQ ID NO: 16 - protein, 502 aa, Escherichia coli K-12 MG1655
  misc_feature (1)..(502): Cas8
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 17 - protein, 160 aa, Escherichia coli K-12 MG1655
  misc_feature (1)..(160): Cse2
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 18 - protein, 363 aa, Escherichia coli K-12 MG1655
  misc_feature (1)..(363): Cas7
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 19 - protein, 224 aa, Escherichia coli K-12 MG1655
  misc_feature (1)..(224): Cas5
MRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 20 - protein, 199 aa, Escherichia coli K-12 MG1655
  misc_feature (1)..(199): Cas6
MYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 21 - protein, 888 aa, Escherichia coli K-12 MG1655
  misc_feature (1)..(888): Cas3
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 22 - DNA, 1455 bp, Oceanicola sp. HL-35
  misc_feature (1)..(1455): Cas8
atgacggtttcgttgaatctgatcactgaccgctggatccccgtcctagacaccacaggcacccgccatacgattgcaccctgggagatggccgattcctcgttcgtcgccccggactggccgcgccccgatctgaacacggcctgcctggagctgctgatcggcctcgtccgtctggccgatccgcctgcccatcccgacgattgggaggataggcaagctccggatgctgatcgcttgcgcgaccgccttgctcctttcgccccagccttcaaccttctgggtgatgggccgcggttcatgcaggaaatgggggggctggttggcgatgtccgagccactgacgtgcttttcattgattccggtggtgatggcggtgcgctgacagtgcgtgaaggacgataccccaacctggacctgcccacggcggcaatggcgctttatgccatgcagacgcaggccccatcgggtggacggggtaatctgacatcgctgcgcggcggcggcccgatgacggtgctggtcgatccaggtggcgggatgtggcctctcatttgggccaacgtgccagacggcaaacctgtcgtgccaaatgttctgccatggatgaggcgcacggtgacttcagaaactggagtgcggttcttcccacatcaaggagatgcagccgaggtgttcttcggtatgccgcgtcggttgtggctagaggctcggaacgacagtgtcactggggtgatccagcgaccctccggcacgaaatacgtgggctggcgtcatcccctgacgccctactatcgccagaaggcgggtgacacgccgctacctgtgcggccgcgcgccggggtgtttggttatcgccactggctaggtattgctgccgaacagggcagtgatctgcgcgagcgccctgcgacggtagaggcgtgggaaagtcgcggtcttggccgccgagctgacatcattgtggccggctgggcaatggagaacatgaaggctcgcgattacatatggtcgcgggcgccgctggtgaccctgcccgaagagcgagcggcctttctccgcgatatgatcgaagcggccgatttactttcggcagccctgcgtggtgccctagccacgcttctgggcgagggagaggggcgtgaggcggcgcgggaagcgttctatgtccgcacgcaggccgccttcgaggggtgggtttcttgtctggataccattgctctggacgccgctgcgcgtggctggctggccgacatgcgcaaggtggcgctggagattttcgaggtgctggcgctgcccggtttggcggatcgcactatcctcgttcaacaggaaatcgtcgccgcgcatcgcgggctgaccggcagcttctcgggctatggaaagcttgggaccaaggcgtttggcgttctgaacctacctgtgccgacacgcaagaaggaggcggcgacatga

SEQ ID NO: 23 - DNA, 525 bp, Oceanicola sp. HL-35
  misc_feature (1)..(525): Cse2
atgagcgatcgcaagcaggtcatcggcacatggtggcggaccaggattggtgcccgcaactccaccgcggcgcgtgcgctggcggccaggctgaaccggggcgagggggtggacgtgctcgcggagcgggcagtcttcgagcttggccgggacttgggcttcctgaagcaacccaaacgtctggtgctgcttgtgcgggtgctggcggcggtgcgtgaggatcgggggggagcgttgccactaagactggggcagggggatcctccacccctatcgccgttgcgttttcagcgtcttttgcgcgccgaaggcgaggagttgaccacgcttctgcgccgcgccctccctatggtcacacggacctgcgacgtgggcgcgcttggcgccgatctgcttgactggtctgactccacccgcgcccgctgggccttcgcctatttcggcgcgaccccgcccgccagaatcaacaactccagaccaacccctgaaacgcccgccctatccgatcaggagaccgaggaatga

SEQ ID NO: 24 - DNA, 1083 bp, Oceanicola sp. HL-35
  misc_feature (1)..(1083): Cas7
atgacgacctttttgcaatttcatgtgctgacgacctatcccccgtcgaaccctaaccgcgacgatcagggccgtccgaagcaggccaatctcggcggcgctccccggctacggctatcgtcgcaatcgatcaagcgggcaatgcgtgagagcccggcatttcagcagggtcttgatggccatatcggcacgcgaacgaagcgactgggcgaagaaatccgcgaagagttggccaagcgagagggcgtgtcgaccgatcaggcgctcgatgtggcttcaaaggtcgccgcgatcttctctaagctggaggcgccgggcaaggataaggtgcaaaaaccacttaccaccactctggccttcgtgtcgcccgacgaatgggcattggcccgcgatctggcgagccggatgttggcgggcgaggagatgccgaaggacaaggaactgaagcgtctggttctccgccgtgccgacggggcagtggatatcgccatgttcggccggatgctggcggatgaaccgggctacaaccgcgaggccgccgtgcaggtgagccacgccatcaccacccatcgcgccattgccgaggacgattggtattccgccgtcgacgatcttaacaagcgcgaggattcaggtgccggacacttgggcgagcatggtttcggttcgggcgtctattacctctatgcctgcgtcaacgtcgatcttctggtagagaacctcgcgggcgatcgggcactcgccgcccgtggtctcgaagcgttggcaaaggcgctcgctaccgcaacaccacgcgggaagcagaacagccatgcccaccacccccgcgcgatctatgtccgcgccgaacgcgggccgcaacagccgcgcgacctgaccggggccttcttttctgctgtggacctgaagtcgaatgacatcgagcggacatcaatcatcgcactggagagaaccgccgaacagattgatcgcgcctacggtgccgcttgtgacgataccgcggtaatggacgtgaaggaggggaatggcactctggccgagatcgctgccttttctggcgcgtcggtatctgccaatgcgtga

SEQ ID NO: 25 - DNA, 765 bp, Oceanicola sp. HL-35
  misc_feature (1)..(765): Cas5
atggcactctggccgagatcgctgccttttctggcgcgtcggtatctgccaatgcgtgagcatttggtctttaccttggccgcggctgtcgcctcgatgggcgaactggcagggcacgagcggcgtggcacctggtcttggccgggacggtcgtcagttctgggcttgtgcgcagcagcccttggtatccggcgtgatggcgatttcagtgcgcttgacggactcgggctggcagtggctgtgttcgatacaggcgaaccgctgcgggattttcacacagccgtcagtatcccgtcgtcagtagcaaagagaccgcagtcgcgtgcagatgcgttgcggatcgacgctggacgcagcaattccacgatcacattgcgcgattaccgggtcggagtgctttatggtgtcgcgttgtggggcgacggcctcccgactgttgcagagaatctggtcgaggctctgcaacggccgaccttcacgctctacttggggcgtaagtcctgccccttggcggccccgcttgcgccacgtgtcctgacggcacccgacgctgcggcggcgctgacagacggaatgacgctaccaccgtggcgtgctggtgcccgtgcaggccagatcgctaccgaagaggaattgcccgcacctcgcacggaaacccgccacgaccggcccactgatcgcaccgcatggcatttcgccccgcgcgcggtgcgtctcgttccctgtgatatcgcacctcgcactgctggacaggtggctgcatga

SEQ ID NO: 26 - DNA, 708 bp, Oceanicola sp. HL-35
  misc_feature (1)..(708): Cas6
atgaccctctggctatcccgagtccgcatcgctcgtggtgctgatcttgatacgctgcggccgctcttggacccaagtgcgctgcatccggcggcgatggacccaaagatgttgggctctcaaacagacgcgcatcaccgcctgatctggacgctgtttgccgatagtcgtgaccggcgccgcgatttcctgtggcgagccgagggtgcagggaagttcactttgctgtcgctgcgtccacctacggcgtcacgagtgtttgaggcacccgaggtgaaggctttctctcctgatcttttgcccggtgaccggctggccttcgctttgcgcgccaacgcaacccgagaccgggccgggtcagccaagggacggcgagtcgatgtggtgatgcacgccttgcataacgtgccgcccgaggaccgcgctgcggcccggatgactctggctcaggacgccgcctcggattggttgacggggcagggcgcgcgcgcgggcttcgtgccggaagaggtgacagcaggtgattattccgtggccgcacttccaagccacactggtaggcgaaaggggcagccgcagtatggtatcctcgatctgaccggcgtgctgcgcgtgaccgatccggcggctttccttgcacggctgggccagggctttggtagggcacgtggttttggttgcgggcttatgctgatccggcgggcctga

SEQ ID NO: 27 - DNA, 1455 bp, Oceanicola sp. HL-35
  misc_feature (1)..(1455): Cas8
atgacagtgagcctgaatctgatcaccgatcgctggattcccgtgctggacacaaccggaacacggcacaccatcgcaccttgggagatggccgacagctcctttgtggccccagattggcccagacctgacctgaacaccgcctgtctggagctgctgatcggactggtgcgcctggccgatccccctgcacaccccgacgattgggaggacaggcaggcccctgacgcagataggctgagggatagactggcaccttttgccccagccttcaatctgctgggcgacggcccacgcttcatgcaggagatgggaggactggtgggcgatgtgcgggcaacagacgtgctgtttatcgattccggcggcgacggaggcgccctgaccgtgagagagggcaggtacccaaacctggacctgccaacagcagcaatggcactgtatgcaatgcagacccaggcacctagcggcggaagaggaaatctgacatccctgaggggaggaggaccaatgaccgtgctggtggaccccggaggaggaatgtggcctctgatctgggcaaacgtgcccgacggcaagccagtggtgcctaatgtgctgccttggatgagaaggacagtgaccagcgagaccggcgtgaggttctttccacaccagggcgatgccgccgaggtgttctttggaatgccacgccggctgtggctggaggcacgcaacgactccgtgacaggcgtgatccagcggccctctggcaccaagtatgtgggctggcgccacccactgacaccctactataggcagaaggcaggcgataccccactgcccgtgaggcctagggcaggcgtgttcggatacaggcactggctgggaatcgcagcagagcagggctctgacctgagggagagaccagcaaccgtggaggcctgggagagccgcggactgggcagaagggccgatatcatcgtggccggctgggccatggagaatatgaaggcaagggactatatctggtcccgggcacctctggtgacactgccagaggagagagccgcctttctgagggatatgatcgaggccgccgacctgctgtctgccgccctgaggggcgccctggccaccctgctgggcgagggcgagggcagagaggccgccagggaggccttttacgtgagaacacaggccgccttcgagggctgggtgagctgtctggataccatcgccctggacgcagcagcaaggggatggctggccgatatgcggaaggtggccctggagatcttcgaggtgctggccctgccaggactggcagacagaaccatcctggtgcagcaggagatcgtggcagcacacaggggactgacaggcagcttctccggctacggcaagctgggcaccaaggcctttggcgtgctgaacctgcctgtgccaacacggaagaaggaggccgccacctaa

SEQ ID NO: 28 - DNA, 525 bp, Oceanicola sp. HL-35
  misc_feature (1)..(525): Cse2
atgagcgacaggaagcaggtcatcggcacatggtggagaaccaggatcggcgccagaaactccaccgcagcaagggccctggcagcacggctgaatagaggagagggagtggatgtgctggcagagagggccgtgtttgagctgggaagggacctgggcttcctgaagcagccaaagcgcctggtgctgctggtgcgggtgctggcagccgtgagggaggataggggaggcgccctgcctctgaggctgggccagggcgaccctccacccctgagcccactgcggtttcagagactgctgagggcagaaggagaggagctgacaaccctgctgaggcgcgccctgccaatggtgacacgcacctgcgacgtgggcgccctgggagcagacctgctggattggtccgactctacacgcgcaagatgggcctttgcctatttcggcgccacccctccagccagaatcaacaatagcaggccaacacccgagacccccgccctgtccgatcaggagacagaggagtaa

SEQ ID NO: 29 - DNA, 1083 bp, Oceanicola sp. HL-35
  misc_feature (1)..(1083): Cas7
atgaccacatttctgcagttccacgtgctgaccacatatcccccttctaaccctaatagggacgatcagggccggccaaagcaggcaaacctgggaggagcaccaaggctgcggctgagctcccagtctatcaagagggcaatgagggagagccctgcattccagcagggcctggatggacacatcggcacacggaccaagagactgggcgaggagatcagggaggagctggcaaagagggagggcgtgagcaccgatcaggccctggacgtggcatctaaggtggcagccatcttcagcaagctggaggcccccggcaaggacaaggtgcagaagcctctgaccacaaccctggcctttgtgagcccagatgagtgggcactggcaagagacctggcatccaggatgctggcaggagaggagatgcccaaggataaggagctgaagcgcctggtgctgcggagagcagatggagcagtggacatcgcaatgttcggaaggatgctggcagacgagccaggatataacagggaggcagcagtgcaggtgagccacgcaatcacaacccacagagccatcgccgaggacgattggtactctgccgtggacgatctgaataagagggaggatagcggcgcaggacacctgggagagcacggatttggctccggcgtgtactatctgtacgcctgcgtgaacgtggatctgctggtggagaatctggcaggcgaccgcgccctggcagcaaggggcctggaggccctggcaaaggccctggcaacagcaaccccaagaggcaagcagaactctcacgcccaccaccccagggcaatctatgtgagggcagagaggggaccacagcagcctagggacctgaccggcgccttcttttctgccgtggatctgaagagcaatgacatcgagcggacatccatcatcgccctggagagaaccgccgagcagatcgatagggcatacggagcagcatgcgacgatacagccgtgatggacgtgaaggagggaaacggcaccctggcagagatcgcagccttcagcggcgcatctgtgagcgccaatgcataa

SEQ ID NO: 30 - DNA, 765 bp, Oceanicola sp. HL-35
  misc_feature (1)..(765): Cas5
atggcactgtggcctcggtctctgccattcctggcccggagatacctgccaatgcgggagcacctggtgtttacactggccgccgccgtggcctccatgggagagctggcaggacacgagaggaggggcacctggtcttggcccggcagatctagcgtgctgggcctgtgcgcagccgccctgggcatccggcgggacggcgatttctccgccctggacggactgggactggcagtggccgtgtttgatacaggagagccactgagggacttccacaccgccgtgtccatcccatcctctgtggccaagaggccacagtctcgggcagatgccctgcgcatcgacgcaggccggagcaactccacaatcaccctgcgcgattacagggtgggcgtgctgtatggagtggccctgtggggcgacggactgcctaccgtggccgagaatctggtggaggccctgcagcgcccaacattcaccctgtacctgggccggaagagctgtccactggcagcaccactggcaccccgcgtgctgacagccccagatgcagcagccgccctgacagacggaatgaccctgccaccatggagagcaggagcaagggcaggccagatcgcaaccgaggaggagctgcctgcaccaagaacagagaccagacacgataggccaacagacaggaccgcctggcactttgcaccaagggccgtgcggctggtgccttgcgatatcgccccaagaacagcaggacaggtggcagcataa

SEQ ID NO: 31 - DNA, 708 bp, Oceanicola sp. HL-35
  misc_feature (1)..(708): Cas6
atgacactgtggctgagccgggtgcggatcgcaagaggagcagacctggataccctgaggccactgctggaccccagcgccctgcacccagcagcaatggaccccaagatgctgggctcccagacagacgcccaccacagactgatctggaccctgtttgccgattccagagacaggcgccgggacttcctgtggagggcagagggcgccggcaagtttacactgctgagcctgagaccccctaccgcctccagggtgtttgaggcccctgaggtgaaggccttcagcccagatctgctgccaggcgacaggctggccttcgccctgcgggccaacgccacccgcgatcgggccggctccgccaagggcagaagggtggacgtggtcatgcacgccctgcacaatgtgccacccgaggatagggcagcagcaaggatgacactggcacaggatgcagcaagcgactggctgaccggacagggagccagagcaggattcgtgcccgaggaggtgacagcaggcgactactccgtggccgccctgccttctcacaccggccggagaaagggccagccacagtatggcatcctggatctgacaggcgtgctgagagtgaccgaccctgcagcctttctggcaaggctgggacagggatttggaagagcaaggggattcggatgcggactgatgctgatcagaagggcataa

SEQ ID NO: 32 - protein, 484 aa, Oceanicola sp. HL-35
  misc_feature (1)..(484): Cas8
MTVSLNLITDRWIPVLDTTGTRHTIAPWEMADSSFVAPDWPRPDLNTACLELLIGLVRLADPPAHPDDWEDRQAPDADRLRDRLAPFAPAFNLLGDGPRFMQEMGGLVGDVRATDVLFIDSGGDGGALTVREGRYPNLDLPTAAMALYAMQTQAPSGGRGNLTSLRGGGPMTVLVDPGGGMWPLIWANVPDGKPVVPNVLPWMRRTVTSETGVRFFPHQGDAAEVFFGMPRRLWLEARNDSVTGVIQRPSGTKYVGWRHPLTPYYRQKAGDTPLPVRPRAGVFGYRHWLGIAAEQGSDLRERPATVEAWESRGLGRRADIIVAGWAMENMKARDYIWSRAPLVTLPEERAAFLRDMIEAADLLSAALRGALATLLGEGEGREAAREAFYVRTQAAFEGWVSCLDTIALDAAARGWLADMRKVALEIFEVLALPGLADRTILVQQEIVAAHRGLTGSFSGYGKLGTKAFGVLNLPVPTRKKEAAT

SEQ ID NO: 33 - protein, 174 aa, Oceanicola sp. HL-35
  misc_feature (1)..(174): Cse2
MSDRKQVIGTWWRTRIGARNSTAARALAARLNRGEGVDVLAERAVFELGRDLGFLKQPKRLVLLVRVLAAVREDRGGALPLRLGQGDPPPLSPLRFQRLLRAEGEELTTLLRRALPMVTRTCDVGALGADLLDWSDSTRARWAFAYFGATPPARINNSRPTPETPALSDQETEE

SEQ ID NO: 34 - protein, 360 aa, Oceanicola sp. HL-35
  misc_feature (1)..(360): Cas7
MTTFLQFHVLTTYPPSNPNRDDQGRPKQANLGGAPRLRLSSQSIKRAMRESPAFQQGLDGHIGTRTKRLGEEIREELAKREGVSTDQALDVASKVAAIFSKLEAPGKDKVQKPLTTTLAFVSPDEWALARDLASRMLAGEEMPKDKELKRLVLRRADGAVDIAMFGRMLADEPGYNREAAVQVSHAITTHRAIAEDDWYSAVDDLNKREDSGAGHLGEHGFGSGVYYLYACVNVDLLVENLAGDRALAARGLEALAKALATATPRGKQNSHAHHPRAIYVRAERGPQQPRDLTGAFFSAVDLKSNDIERTSIIALERTAEQIDRAYGAACDDTAVMDVKEGNGTLAEIAAFSGASVSANA

SEQ ID NO: 35 - protein, 254 aa, Oceanicola sp. HL-35
  misc_feature (1)..(254): Cas5
MALWPRSLPFLARRYLPMREHLVFTLAAAVASMGELAGHERRGTWSWPGRSSVLGLCAAALGIRRDGDFSALDGLGLAVAVFDTGEPLRDFHTAVSIPSSVAKRPQSRADALRIDAGRSNSTITLRDYRVGVLYGVALWGDGLPTVAENLVEALQRPTFTLYLGRKSCPLAAPLAPRVLTAPDAAAALTDGMTLPPWRAGARAGQIATEEELPAPRTETRHDRPTDRTAWHFAPRAVRLVPCDIAPRTAGQVAA

SEQ ID NO: 36 - protein, 235 aa, Oceanicola sp. HL-35
  misc_feature (1)..(235): Cas6
MTLWLSRVRIARGADLDTLRPLLDPSALHPAAMDPKMLGSQTDAHHRLIWTLFADSRDRRRDFLWRAEGAGKFTLLSLRPPTASRVFEAPEVKAFSPDLLPGDRLAFALRANATRDRAGSAKGRRVDVVMHALHNVPPEDRAAARMTLAQDAASDWLTGQGARAGFVPEEVTAGDYSVAALPSHTGRRKGQPQYGILDLTGVLRVTDPAAFLARLGQGFGRARGFGCGLMLIRRA

SEQ ID NO: 37 - DNA, 90 bp, Oceanicola sp. HL-35
  misc_feature (1)..(90): CRISPR
ctgttccccgcacacgcggggatgaaccgggttcttcgatctgcgcatccatgatgccgccctgttccccgcacacgcggggatgaaccg

SEQ ID NO: 38 - DNA, 1554 bp, Pseudomonas sp. S-6-2
  misc_feature (1)..(1554): Cas8
atggatttgttaagtgatacctggctgcagtgccgccatcgtgatggcacgctgaagccgatagctattgggcagatagggctagaagactgtttagagctggttgcgccacgccccgacttccgtggtgcgctctatcagtttctgatcgggttgctgcaaaccgcctacgcgccagaggatcttcaggagtggcgtgatcgctatgccaacccacctaccgctgatgacctggcagaggttttcgctccttaccgcgacgccttccagctggaaaactcagggcctacctttatgcaggacctgaccttgcccgatgacgtcaatcagctgccggtgctggagctgttgattgatgccggctcatcgagcaatcagtatttcaacaagccggcggttgagcacggcatgtgcgagggctgctttacccaggcgttgctcaccatgcagttgaacgcgccctctggcggacgaggcattcggacctcgctgcgtggtggcggtccgttgacgaccttgctggtgccagccgaacagaacgcgacgctttggcaaaagctctggctcaacgtcttgcctcttgatgcactcgatcacccgccgatcaagatgctcagtgacgtattgccctggctggcaccaacccgcaccagcgatgacaaacagggccaggatacaccgccggagtcggtgcaccccttgcaggcgtactggagcatgccgcggcgcattcgcctggatgcagccaccttggatcagggggattgcgcggtatgcggtgcccagaatgtaaagcgtatccgtcattaccgtacccgccatggcggcaccaactacaccgggacatggactcacccgctgacaccctacagcctggactcgaaaggagaaaagccgccgctctcgatcaaggggcgtcaggccgggcgaggttaccgtgactggctgggtctggtacttggtaatgaagatcaccagccggatgccgcgcaggttgttcggcacttcaccgccaaactgggcaagccgtccgtgcgcttgtggtgcttcggtttcgatatgtcgaacatgaaagcgttgtgctggtacgacagtctgttgccggtacacggcgtggcacctgacgttcagcggaagtttacccgcagcgtcaagcaggtgctggattcggccaatgacatggcctccgttctgcacaaacaggtcaaagcggcctggtttcgccgtccgggcgatgccggtcaggagcctgccgtgacgcaaagtttttggcagggctctgagacggccttttatcaggtgctggagcagctcagcaagctcgattttgacagcgcggccgagttggcagcgatctacagagcctggttgcaggccacgcgtcgtctggtgctaagtctgtttgaccactgggtgctgagcggtccgctggaagatatggacatgcaacgcgtggtcaaggcccgggctgatctggccaaagagctgaatactggcaaggcacaaaagccgctgtggacaatcgttaatcaacatctcaaggagcaggcatga

SEQ ID NO: 39 - DNA, 642 bp, Pseudomonas sp. S-6-2
  misc_feature (1)..(642): Cse2
atgaagccgagaaagcccagattgaacgaggcccagcagcgctgggtgcgcgactggtggcgcgccttgcagccccgcgccgagggtgatgaacccatacccggcgagctgtctgtcatggggaggggtgagcgggcacaactgcgccgctgcaccgatgccgatgagctgcttacccagtcagccaccctgctgctggcgcaccgtttggttgcactcaatggtgagcgaggccctttgcctgataattccttgagctacgagcgcatggcctgggtggccggggtgctggctaacgtcaaggacgacctgcgtgacggcaagagtctggctacgcaccttgggcaggctgctgatgccgagcgcccgccgatgagcgaactgcgtttcagggctatgcagcgcggcacggcgatgcaggagctattcctgcattggcgtcgggcgttgcaactggccgggggcaagactgatgtggcacacctggcagatgacctgctgagctggcagatagagcagggccagtctgctgctcaggcgagcaacggggtcaaatttcactgggcctatgactactatctgagcgcccgggaccgggcagccgccaaagaacctgaattcaacaaggagatatccaaatga

SEQ ID NO: 40 - DNA, 1035 bp, Pseudomonas sp. S-6-2
  misc_feature (1)..(1035): Cas7
atgactcgttttgtgcaattgcacctgctgacgtcctacccgcccgccaaccttaaccgcgatgatctgggcaacccgaaaaccgcacgcctaggcggtgttgaacgtctgcgtgtgtcctcgcaaagtctcaaacgcgcttggcgtacctcggagctgtttcagcaacagttggccgggactatcggcacgcgcaccaagcgccttggtatcgaggttttcgaggcactgctgggtgctggtgtcactgagaagcaggcgcgtgagtgggctggacaaatcgccaaggtttacggggctgcgaaaaaggataatccactggaaatcgagcagctggtccatatcgcgcctgaagagcgtgcttcgctggatcaactggtggccacccttgccgcggaaaaacgcggcccaacggatgaggagttggacgccctgctgcaccaccagacagcggtggatatcgccatgtttggtcgcatgctggcctccaaaacacagttcaacggagaggccgcagtgcaggtagcccatgccatcggcgtgcacgcatcggctattgaggatgactacttcaccgccgttgacgatctcaaccgcaatgatcctggcgctgcgcatatcggtgaatccggtttcgccgctgcagtgttctaccagtacatctgcatcgaccgcgatctgctgaaacggaatctggggggcgatgaagtgctgactcaaaaggcactccgggctctgactgaagcggcgctcaaagtggggcccagcggcaagcaaaacagcttcgccagccgggctttcgcccactttgcgctggccgagaaaggcactgatcagccgcgctctctgtcactggccttcgtcaaaccggtggccggcacagactatgccggtgatgccgttgcggccttgcaacaggtgcgcgacaacatggacaaggtctatggagtctgcgctgaaagccgctgccagttcaatgtgctgacgggtgaagggtcagtggccgacctgcttgattttgtcgccgcggagtga

SEQ ID NO: 41 - DNA, 768 bp, Pseudomonas sp. S-6-2
  misc_feature (1)..(768): Cas5
atgactgactatctactgctgcggctctatggcccgctggccagctggggcgagattgcagtcggcgaatcgcgacactcggcggtacaaccgtcgcgttccgcgctgcttggtttgctgggtgcagcgctgggtatcgagcggcacgatgatgccgctcagcaggcgcttgtggacggttaccgctttgcgatcaagctggaatgcataggttcgcccttgcgtgactatcacacggttcaggtaggcgtgccgccgcgcaagttccagtttcgctcacgtcgtcaggaattggctgccgacaaagtcgatactattctgtcgacccgtgagtaccgctgtgacagcctcgcgttggttgctgtggaagccttgcccggtgcgccggtggacttggcctccctggccgaagcgctgcgtaagccgcgcttcgccttgtatctggggcgcaaatcctgcccgcttgctttgccgttgagtccaaaaattcttgccgccagcagtgtgcgtgaggtgttcgacaatctggaattgccttccttgctgggtttgttggatcgctatcagcccgagcaagcctggccaagtcgacaggaccaacaggcactacgtcccggtgtcgcgcgatactattgggaagacgggatgactgctggcatggcgccgagctttgaggcccaacgacatgatcagccactctcccgtcgccgctggcagtttgcaccgcgccgcgaatgggtggccttgaatgatggagggcagtcatga

SEQ ID NO: 42 - DNA, 663 bp, Pseudomonas sp. S-6-2
  misc_feature (1)..(663): Cas6
atgagccattatttctcgcttgttagactgatcggcagtccgcgtcacgatgcctggctgcgtgacttgtcgcgccatggtgaagcctacagggatcatgcgttgatctggcgcctgttcccgggcgatggcgctgcacgtgactttgttttccgccgccttgaggacgaaaaaagtttctatgtggtttcagcacgaccaccacaggccgatgcggggttattccatatccagagcaaagcctattcgcctgagttggccgagggtgattgggtgcgattcgacctgcgtgccaatcccaccgtcagcgtgcgccgggaaaatggtcgctcacagcgtcatgatgtgctgatgcacgccaagcagcttgccagcacagaaaaatcggcactacctgagcggctggaagcagcaggcagggaatggctgaaagacagggcggaacgctggggactggatttgcgtactgacagtcttatgcaaaacggttatcgccagcagcggttgaagcgcaagggtaaacacatcgctttttccacgttggactatcagggcattgcccaggtgacggaccctgaacaattgcgccgggcactgctcgacggggttggacacagcaagggctttggctgcgggctgttgctggtaaaacgtgtggactga

SEQ ID NO: 43 - DNA, 1554 bp, Pseudomonas sp. S-6-2
  misc_feature (1)..(1554): Cas8
atggacctgctgtctgatacatggctgcagtgcaggcacagggacggcaccctgaagcctatcgccatcggccagatcggcctggaggactgtctggagctggtggcacctcggcccgacttccggggcgccctgtaccagttcctgatcggcctgctgcagacagcctatgccccagaggacctgcaggagtggagagatagatacgccaaccctccaaccgccgacgatctggccgaggtgtttgccccttatagggatgccttccagctggagaactccggcccaacattcatgcaggacctgaccctgccagacgatgtgaatcagctgcccgtgctggagctgctgatcgacgcaggctcctctagcaaccagtactttaataagccagcagtggagcacggaatgtgcgagggctgtttcacacaggccctgctgaccatgcagctgaatgcaccatccggcggaaggggcatcagaacatctctgaggggaggaggacctctgaccacactgctggtgccagccgagcagaacgccaccctgtggcagaagctgtggctgaatgtgctgcccctggacgccctggatcacccacctatcaagatgctgtctgatgtgctgccatggctggcaccaacccggacaagcgacgataagcagggccaggacacaccacccgagtctgtgcacccactgcaggcctactggagcatgcctaggcggatcagactggacgcagccaccctggaccagggcgattgcgccgtgtgcggagcacagaacgtgaagcgcatccggcactacagaacaaggcacggcggcaccaattataccggcacatggacccaccccctgaccccttattctctggatagcaagggcgagaagcctccactgagcatcaagggccggcaggcaggaaggggatacagggactggctgggactggtgctgggaaacgaggaccaccagcctgatgccgcccaggtggtgaggcacttcacagccaagctgggcaagccatccgtgcgcctgtggtgctttggcttcgacatgagcaatatgaaggccctgtgctggtacgattccctgctgccagtgcacggagtggcccctgacgtgcagaggaagtttacccgcagcgtgaagcaggtgctggactctgccaacgatatggccagcgtgctgcacaagcaggtgaaggccgcctggttcagaaggcccggcgacgcaggacaggagcctgcagtgacacagtctttttggcagggcagcgagaccgccttctatcaggtgctggagcagctgtccaagctggactttgattctgccgcagagctggcagcaatctacagagcatggctgcaggcaacccgccggctggtgctgagcctgttcgatcactgggtgctgtccggccctctggaggacatggatatgcagcgggtggtgaaggcaagagcagacctggccaaggagctgaacacaggcaaggcccagaagccactgtggaccatcgtgaatcagcacctgaaggagcaggcctaa

SEQ ID NO: 44 - DNA, 642 bp, Pseudomonas sp. S-6-2
  misc_feature (1)..(642): Cse2
atgaagccaaggaagcctcggctgaatgaggcccagcagagatgggtgagggattggtggagggccctgcagccaagggcagagggcgacgagccaatccctggagagctgagcgtgatgggaaggggagagagggcacagctgcggagatgtaccgacgccgatgagctgctgacacagtccgccaccctgctgctggcacacaggctggtggccctgaacggagagagaggaccactgcccgataatagcctgtcctatgagaggatggcatgggtggcaggcgtgctggcaaacgtgaaggacgatctgagagatggcaagtccctggccacccacctgggacaggcagcagacgcagagaggcctccaatgtctgagctgcgctttcgggccatgcagagaggcacagccatgcaggagctgttcctgcactggaggcgcgccctgcagctggcaggaggcaagaccgacgtggcacacctggcagacgatctgctgagctggcagatcgagcagggacagtctgccgcacaggccagcaatggcgtgaagtttcactgggcctacgactactatctgtctgccagagatagggccgccgccaaggagccagagttcaacaaggagatcagcaaataa

SEQ ID NO: 45 - DNA, 1035 bp, Pseudomonas sp. S-6-2
  misc_feature (1)..(1035): Cas7
atgacacgctttgtgcagctgcacctgctgacctcttatccccctgccaacctgaatagggacgatctgggaaaccctaagacagcaaggctgggaggagtggagagactgagggtgagctcccagtctctgaagcgcgcctggcggacaagcgagctgtttcagcagcagctggcaggaaccatcggaaccagaacaaagaggctgggcatcgaggtgttcgaggccctgctgggagcaggagtgaccgagaagcaggcaagggagtgggcaggacagatcgcaaaggtgtacggagccgccaagaaggataaccccctggagatcgagcagctggtgcacatcgcccctgaggagagggccagcctggaccagctggtggccacactggcagcagagaagagaggaccaaccgacgaggagctggatgccctgctgcaccaccagacagccgtggacatcgccatgtttggcaggatgctggccagcaagacccagttcaatggagaggcagcagtgcaggtggcacacgcaatcggagtgcacgcctccgccatcgaggacgattacttcaccgccgtggacgatctgaaccgcaatgatccaggagcagcacacatcggagagtccggctttgccgccgccgtgttctaccagtatatctgcatcgaccgggatctgctgaagagaaacctgggcggcgacgaggtgctgacacagaaggccctgcgcgccctgaccgaggccgccctgaaggtcggccccagcggcaagcagaattcctttgcctctagggcctttgcccacttcgccctggccgagaagggcacagatcagccacgctccctgtctctggccttcgtgaagccagtggcaggaaccgactacgcaggcgatgccgtggccgccctgcagcaggtgagggacaacatggataaggtgtatggcgtgtgcgccgagtcccgctgtcagtttaatgtgctgacaggagagggctctgtggcagacctgctggatttcgtggcagcagagtaa

SEQ ID NO: 46 - DNA, 768 bp, Pseudomonas sp. S-6-2
  misc_feature (1)..(768): Cas5
atgaccgactacctgctgctgaggctgtatggaccactggcatcctggggagagatcgcagtgggagagtctaggcacagcgccgtgcagccttctcgcagcgccctgctgggactgctgggagccgccctgggcatcgagagacacgacgatgcagcacagcaggccctggtggatggataccggttcgccatcaagctggagtgtatcggctctcccctgagagactatcacaccgtgcaagtgggagtgccaccaaggaagttccagtttagaagccggagacaggagctggcagcagacaaggtggatacaatcctgtccaccagagagtataggtgcgattctctggccctggtggcagtggaggccctgccaggagcacccgtggacctggccagcctggcagaggccctgcgcaagccaaggtttgccctgtacctgggaaggaagagctgtccactggccctgcctctgtccccaaagatcctggccgcctctagcgtgcgcgaggtgttcgataacctggagctgccttctctgctgggcctgctggacaggtaccagcctgagcaggcctggccaagcagacaggatcagcaggccctgaggccaggagtggcaaggtactattgggaggacggaatgacagcaggaatggcaccttcttttgaggcccagaggcacgatcagccactgagcaggcgccggtggcagttcgcaccaagaagggagtgggtggccctgaacgatggaggacagtcctaa

SEQ ID NO: 47 - DNA, 663 bp, Pseudomonas sp. S-6-2
  misc_feature (1)..(663): Cas6
atgtctcactacttcagcctggtgaggctgatcggctcccctaggcacgacgcctggctgagggatctgagcagacacggagaggcctacagggaccacgccctgatctggagactgttccctggcgacggagcagcaagggatttcgtgtttcgccggctggaggatgagaagtccttttatgtggtgtctgccaggccacctcaggcagacgcaggactgttccacatccagtccaaggcctactctccagagctggcagagggcgactgggtgaggttcgatctgcgcgccaaccccacagtgtctgtgagaagggagaatggcagaagccagaggcacgatgtgctgatgcacgccaagcagctggccagcaccgagaagtccgccctgcccgagcggctggaggcagcaggaagagagtggctgaaggacagggcagagcggtggggcctggacctgagaaccgattccctgatgcagaacggctacagacagcagaggctgaagcgcaagggcaagcacatcgccttttctacactggactatcagggcatcgcccaggtgaccgatcccgagcagctgcgccgggccctgctggacggagtgggacactccaagggattcggatgcggactgctgctggtgaagcgggtggattaa

SEQ ID NO: 48 - protein, 517 aa, Pseudomonas sp. S-6-2
  misc_feature (1)..(517): Cas8
MDLLSDTWLQCRHRDGTLKPIAIGQIGLEDCLELVAPRPDFRGALYQFLIGLLQTAYAPEDLQEWRDRYANPPTADDLAEVFAPYRDAFQLENSGPTFMQDLTLPDDVNQLPVLELLIDAGSSSNQYFNKPAVEHGMCEGCFTQALLTMQLNAPSGGRGIRTSLRGGGPLTTLLVPAEQNATLWQKLWLNVLPLDALDHPPIKMLSDVLPWLAPTRTSDDKQGQDTPPESVHPLQAYWSMPRRIRLDAATLDQGDCAVCGAQNVKRIRHYRTRHGGTNYTGTWTHPLTPYSLDSKGEKPPLSIKGRQAGRGYRDWLGLVLGNEDHQPDAAQVVRHFTAKLGKPSVRLWCFGFDMSNMKALCWYDSLLPVHGVAPDVQRKFTRSVKQVLDSANDMASVLHKQVKAAWFRRPGDAGQEPAVTQSFWQGSETAFYQVLEQLSKLDFDSAAELAAIYRAWLQATRRLVLSLFDHWVLSGPLEDMDMQRVVKARADLAKELNTGKAQKPLWTIVNQHLKEQA

SEQ ID NO: 49 - protein, 213 aa, Pseudomonas sp. S-6-2
  misc_feature (1)..(213): Cse2
MKPRKPRLNEAQQRWVRDWWRALQPRAEGDEPIPGELSVMGRGERAQLRRCTDADELLTQSATLLLAHRLVALNGERGPLPDNSLSYERMAWVAGVLANVKDDLRDGKSLATHLGQAADAERPPMSELRFRAMQRGTAMQELFLHWRRALQLAGGKTDVAHLADDLLSWQIEQGQSAAQASNGVKFHWAYDYYLSARDRAAAKEPEFNKEISK

SEQ ID NO: 50 - protein, 344 aa, Pseudomonas sp. S-6-2
  misc_feature (1)..(344): Cas7
MTRFVQLHLLTSYPPANLNRDDLGNPKTARLGGVERLRVSSQSLKRAWRTSELFQQQLAGTIGTRTKRLGIEVFEALLGAGVTEKQAREWAGQIAKVYGAAKKDNPLEIEQLVHIAPEERASLDQLVATLAAEKRGPTDEELDALLHHQTAVDIAMFGRMLASKTQFNGEAAVQVAHAIGVHASAIEDDYFTAVDDLNRNDPGAAHIGESGFAAAVFYQYICIDRDLLKRNLGGDEVLTQKALRALTEAALKVGPSGKQNSFASRAFAHFALAEKGTDQPRSLSLAFVKPVAGTDYAGDAVAALQQVRDNMDKVYGVCAESRCQFNVLTGEGSVADLLDFVAAE

SEQ ID NO: 51 - protein, 255 aa, Pseudomonas sp. S-6-2
  misc_feature (1)..(255): Cas5
MTDYLLLRLYGPLASWGEIAVGESRHSAVQPSRSALLGLLGAALGIERHDDAAQQALVDGYRFAIKLECIGSPLRDYHTVQVGVPPRKFQFRSRRQELAADKVDTILSTREYRCDSLALVAVEALPGAPVDLASLAEALRKPRFALYLGRKSCPLALPLSPKILAASSVREVFDNLELPSLLGLLDRYQPEQAWPSRQDQQALRPGVARYYWEDGMTAGMAPSFEAQRHDQPLSRRRWQFAPRREWVALNDGGQS

SEQ ID NO: 52 - protein, 220 aa, Pseudomonas sp. S-6-2
  misc_feature (1)..(220): Cas6
MSHYFSLVRLIGSPRHDAWLRDLSRHGEAYRDHALIWRLFPGDGAARDFVFRRLEDEKSFYVVSARPPQADAGLFHIQSKAYSPELAEGDWVRFDLRANPTVSVRRENGRSQRHDVLMHAKQLASTEKSALPERLEAAGREWLKDRAERWGLDLRTDSLMQNGYRQQRLKRKGKHIAFSTLDYQGIAQVTDPEQLRRALLDGVGHSKGFGCGLLLVKRVD

SEQ ID NO: 53 - DNA, 90 bp, Pseudomonas sp. S-6-2
  misc_feature (1)..(90): CRISPR
gtgttccccgcacctgcggggatgaaccgggccggggcgtttgcgctgtcaggggcgtcccgtgttccccgcacctgcggggatgaaccg

SEQ ID NO: 54 - DNA, 1536 bp, Salmonella enterica subsp. enterica serovar Muenster strain
  misc_feature (1)..(1536): Cas8
atggatttaaccaaagagaaatggcttcccgtcatattctcaaacggcgaaaaaacgagaatatcattacgcgatcttctggataaccgcattcaggatcttgcatacccccggcccgattttcagggggctgcatggcaaatgctgattggtattttacaatgtaccgtcgcgccggaagataaagaagaatgggcagatatctggcatgaaagtatcgaattcgaacaatgggagaaggcgttaaatacgatttctctggctctacagttcggcgagcaaaaaccttccttcctgcaaagttttgatcctctcgatagtgaatatggttctattgccgggctgctggtggatgcgccgggcggtaatgcgctcaagctcaataaagatcattttgtaaaacgtggcaacgtagaacaaatatgtcctcactgcgcggcgatagcgctatttgcgattcaaaccaattcacctgccggcggggcgggttaccgggtagggatgcgcggcggtggtccgctgactacgctggtggtaccgcaggaagaagataaatatccactatggaaaaaactttggcttaacgttttgccgcaggaagagccgccgaatgttacacagcatccactcatttttccctggcttgcgccgacgaaaaccagcgaaaaagcggggaatgtggtcacaccggataatgcgcaccccttgcaagcctactggggaatgccgcggcgcatagaactggatttcacccacactgtggcaggtatctgcgatttgtgcggggagcatcacgaatcactgctactgcaaatgcgtagtaaaaattatggcgttcagtacgacagttggttacatcctttctccccatatcggcaggcattgaaagatccatccgcaccctggctggcgtttaaagggcagccgggcgggttaagttataaagactggttggggctgatgctcaatcgtgaggataagttcaacaaaatgcagcctgcaaaggtcgttcgtgccgctggtcagcggaacaaaatgagcctgtggtgctttgcctgggatatggataaggccaaggtccgctgctggtatcagcaccgtattccgctcattagcgtttcgcacgaagagcaatttctcgctgtgcttaacattgtgctggtgctggctagtgagtcgctgtcgctgttacggaacgcgttaaagagcgccaaattcgattgtccgaaagaagccaaaatggattttagtatggtggatatcgccttctggcaggaaaccgaacccgcttttcggacgttgcaagaggcgctggctgtcgatccgcttcggcaggatacacagactcgtcacgcagtaagtcagtgggaggcggaattagcacactatctatttcacgtttttgatcgtgatgccctgaccaaccccgactgcccggacgatatcctgcagcgccagctgacggcccgacaggatttagccagcagctatcgtaaacataaagcgcgcaaggatgtgttggcgctggtcgaataa

SEQ ID NO: 55 - DNA, 603 bp, Salmonella enterica subsp. enterica serovar Muenster strain
  misc_feature (1)..(603): Cse2
atgctgaatagcaatacagcagtgttatgcagaattctccaccccgatgcgcagaaggcgctacttgactggtttgctacgctgtctgagcgttacgagcgcaaggatggtaaacgagtcaacggtcgcgcctggcgggctgagttgaaaagaatggcgccgccatatggcgtaatgatatgtgaagggcatgacgctctccgccaggcgctgcttaaacatatgcgactgcaacctcttgatgagatggctctggcgctgtttgtcagcgtcgctgtgcatattaagagccataaggcgaatattagtttcgctgcacaattaggggaaaagcttaaaggttctacgccgtgcgtttctgttctgcgttttgaacgtttgcaaaaagcgtccgacccggaaacattttgccagttgttgattcaggcagtgaagattcgcggtacggagggggtgaatgttctttcacttgccgatggcattttcctgtggatggaagagtggcaacgacgcgaaaaccatcagccggaattccgtaacccctttgaacgaaatcgcatccgttgggcgaacgaatatctttccacgtcgcgtggcaaataa

SEQ ID NO: 56 - DNA, 1065 bp, Salmonella enterica subsp. enterica serovar Muenster strain
  misc_feature (1)..(1065): Cas7
ttgataatgacaacttttattcaactgcatttattgactgcttatgcgcccgctaacctgaatcgtgatgagtctggcagaccgaagaccgcgtttatgggaggagttgagcgtttacgcgtatcgtcgcaaagtctgaagcgtgcctggcgggtgtcggaaacttttgaagcggcaatggatggttttatgggtaagcgtactcgtcgaattggcgtggattatgtttatcgtccgatgaaagatgccggaattgaagaaaaaattgctaagagttcgtctgagttaatcgctaagcaatttggcaagcttaaaagtgataaagatgcgaaaccggaaaaaaatctcgaaattgagcagatcgttcacgtcagtaaccatgaaattagtttgattaagcaactggttgatacgctaattgccgacaaacgcgaacctaacgatgaagaagtggagttgttgcgcaaagagcagcgtagcgtagatatggcgctgtttggccgtatgctggcgtcatcgcctgagttcaacgtcgaggctgcttgtcaggtatcccatgcgttgggcgtaagtgccgtgaccgttgagtctgattttttcaccgccgttgacgatctgaataataaagaggaagacgcaggttccgggcatatgggcgagcagggttttgcctcggcgcttttctatacctatgtctgtatcagccgcgatctgctggtggaaaacctgggtggtaacgaagaactggcgaagcgtactatcgcggcactcactgaaacagcgttaaccgtctcgccaaccggtaaacaaaacagcttcgcttctcgtgcctatgccacctatgcgttggccgaagtcgggcaaaaacaaccgcgttctctggcggcggcatttttccagccggtacgcgataccgatcaaattccggcggcaataacccgtttaaaacagcagcgcgccagcttcgataacgtatacggaaactgtgcagacgattatcgcgagttgaacgttcaggaaggtacgggatctctggcggaattactggcctttgttagccagtaa

SEQ ID NO: 57 - DNA, 726 bp, Salmonella enterica subsp. enterica serovar Muenster strain
  misc_feature (1)..(726): Cas5
atgaaggaatatctggtttttcagctctatgcgccgctggcgtcgtggggggaagaagcgtctggcgagattcgccactcagctacggttcccacgcgctctgcgctattgggtctgcttgccgcagcgttaggaattcgtcgcgacgaagaagcgcggctgaataactttaaccggcactatcatctggcggtgcacgcgttggcttcacaagatcgctggttgcgggattatcacacggttagcgcgccgcgagaaaacaaaaagaatcgttattacacgcgccgggatgaactgactctcgcgccggatgaagtggggacgcttatctcgcagcgagaatatcgctgcgacggctactggcatgtggcaataagcgccacgcctgatgcaccacattcgcttagcgaattgcgagaggcgctgctgacaccgcattttccgctctatctggggagaaaatcctgcccgctggcgttaccgttagcggcgcgtttaatgaccggcaccttaaaagaggtattcacccatgctgtggaggagatttccgcagcggaattaagtggatttaccctgcgtgagggtatttgttattgggatgatcctgatgaggagagtctggtctggcaacaaaagcagcatagcaataaccagccagttagccgccaacgctggcagtttggcggctacacccgcttcaatgggccgttgcaggagagaacataa

SEQ ID NO: 58 - DNA, 705 bp, Salmonella enterica subsp. enterica serovar Muenster strain
  misc_feature (1)..(705): Cas6
atgtatctttctcgtattcaactccggtttaataatttgcgaccggagatgttggcaaagtggaattcagccaggccttatgccagccaccagtggttatggcagctctttccggaacaggaattgcgtcagtttctgtttcgcgaagaggcgcatggcggcttttttatgctctcggcaataccgccgttatcgcagcactccctgtttcttattgaaaccaaaccatttaatccgcaactgacaaatggtcttgagcttgattttcaactacgagctaacccggtgataacccgtaacggtaagcgcagtgacgtgatgatgaacgcgaaacatcaggcgaaggcgaatggtgtggagaaagaacggtggtgggagcttcaacagcaggccgcgcaggcgtggctggaacaacaagggcagcagcatggtttccggttgattgcaccggaacctgatgatttcgctatgtgggctggtgacgagtacagtgaattgcaggcacattgtggatgcgtgcaagcgtatcagcagcatcgttttgtccgtaaagaccagcaaaaaccgatcactttcagtagcgttgattttagcggtgcgctctgtatcaccgatgcagcactgtttaaacaggctttattttccggattaggtaaaagtaaagcgctgggctgcggaatgctgatggtaaaaaggaaacgctga

SEQ ID NO: 59 - DNA, 1536 bp, Salmonella enterica subsp. enterica serovar Muenster strain
  misc_feature (1)..(1536): Cas8
atggacctgaccaaagagaagtggctgcctgtgatcttttctaacggcgagaagacaagaatcagcctgagggacctgctggataatcgcatccaggacctggcctatcctcggccagatttccagggagcagcatggcagatgctgatcggcatcctgcagtgtaccgtggccccagaggacaaggaggagtgggccgatatctggcacgagtctatcgagtttgagcagtgggagaaggccctgaacacaatcagcctggccctgcagttcggcgagcagaagccctcttttctgcagagcttcgaccctctggattccgagtacggctctatcgcaggactgctggtggacgcaccaggaggcaacgccctgaagctgaataaggatcactttgtgaagagaggcaacgtggagcagatctgcccacactgtgcagcaatcgccctgttcgccatccagaccaatagccctgcaggaggagcaggctatagggtgggaatgaggggaggaggaccactgaccacactggtggtgcctcaggaggaggacaagtacccactgtggaagaagctgtggctgaacgtgctgccacaggaggagccccctaatgtgacccagcacccactgatctttccctggctggcccctaccaagacatccgagaaggccggcaacgtggtgacacctgataatgcccacccactgcaggcctactggggaatgccaaggaggatcgagctggacttcacccacacagtggcaggaatctgcgacctgtgcggagagcaccacgagtccctgctgctgcagatgcgctctaagaactacggcgtgcagtatgactcttggctgcacccctttagcccttataggcaggccctgaaggacccctccgccccatggctggccttcaagggacagccaggaggactgtcttacaaggactggctgggcctgatgctgaacagggaggataagtttaataagatgcagccagcaaaggtggtgcgcgcagcaggccagcggaataagatgagcctgtggtgcttcgcctgggacatggataaggccaaggtgcgctgttggtaccagcacagaatccccctgatctccgtgtctcacgaggagcagttcctggccgtgctgaacatcgtgctggtgctggccagcgagtccctgtctctgctgcggaatgccctgaagagcgccaagtttgactgccctaaggaggccaagatggacttttccatggtggatatcgccttctggcaggagaccgagcctgccttcagaacactgcaggaggccctggcagtggacccactgagacaggatacccagacaaggcacgccgtgagccagtgggaggcagagctggcccactatctgtttcacgtgttcgaccgcgatgccctgaccaaccctgattgtccagacgatatcctgcagagacagctgacagcaaggcaggacctggcaagctcctacaggaagcacaaggcccggaaggatgtgctggccctggtggagtaa

SEQ ID NO: 60 - DNA, 603 bp, Salmonella enterica subsp. enterica serovar Muenster strain
  misc_feature (1)..(603): Cse2
atgctgaacagcaataccgccgtgctgtgcagaatcctgcaccctgacgcccagaaggccctgctggattggttcgccacactgagcgagcggtacgagcggaaggacggcaagcgcgtgaacggaagagcatggagggcagagctgaagaggatggcaccaccctacggcgtgatgatctgtgagggacacgacgccctgagacaggccctgctgaagcacatgaggctgcagcctctggatgagatggcactggccctgttcgtgagcgtggcagtgcacatcaagtctcacaaggccaacatcagcttcgccgcacagctgggagagaagctgaagggctccaccccatgcgtgtctgtgctgcgctttgagcggctgcagaaggccagcgaccccgagaccttctgtcagctgctgatccaggccgtgaagatcaggggcacagagggcgtgaatgtgctgtccctggccgatggcatcttcctgtggatggaggagtggcagaggcgcgagaaccaccagccagagtttcgcaaccccttcgagaggaatcgcatccggtgggccaatgagtacctgtctaccagccgcggcaagtaa

SEQ ID NO: 61 - DNA, 1065 bp, Salmonella enterica subsp. enterica serovar Muenster strain
  misc_feature (1)..(1065): Cas7
atgatcatgaccaccttcatccagctgcacctgctgaccgcatacgcacctgccaacctgaatagagacgagagcggcaggccaaagacagccttcatgggaggagtggagcggctgagagtgagctcccagagcctgaagagagcctggagggtgtccgagacctttgaggccgccatggatggcttcatgggcaagagaacacggagaatcggcgtggactacgtgtataggcctatgaaggatgccggcatcgaggagaagatcgccaagtctagctccgagctgatcgccaagcagttcggcaagctgaagagcgacaaggatgccaagccagagaagaacctggagatcgagcagatcgtgcacgtgagcaatcacgagatctccctgatcaagcagctggtggacaccctgatcgccgataagagggagccaaacgacgaggaggtggagctgctgcgcaaggagcagcggtccgtggatatggccctgtttggccgcatgctggcctctagccccgagttcaatgtggaggcagcatgccaggtgtctcacgccctgggcgtgagcgccgtgaccgtggagtccgacttctttacagccgtggacgatctgaacaataaggaggaggatgcaggctccggccacatgggagagcagggatttgcctctgccctgttctacacctacgtgtgcatcagccgcgacctgctggtggagaacctgggaggcaatgaggagctggccaagcggacaatcgccgccctgaccgagacagccctgaccgtgagccctacaggcaagcagaacagctttgcctcccgcgcatacgcaacctatgccctggcagaagtgggacagaagcagccacgctccctggcagcagccttctttcagcccgtgcgggacaccgatcagatccctgccgccatcacacgcctgaagcagcagcgggcctcttttgacaacgtgtacggcaattgcgccgacgattatagggagctgaacgtgcaggagggaaccggctccctggcagagctgctggccttcgtgtctcagtaa

SEQ ID NO: 62 - DNA, 726 bp, Salmonella enterica subsp. enterica serovar Muenster strain
  misc_feature (1)..(726): Cas5
atgaaggagtacctggtgtttcagctgtatgcacctctggcaagctggggagaggaggcctccggcgagatcagacactctgccaccgtgccaacaaggtccgccctgctgggactgctggcagccgccctgggcatccggcgggatgaggaggccagactgaacaatttcaataggcactaccacctggcagtgcacgccctggcatcccaggacagatggctgagggattatcacaccgtgtctgccccccgcgagaacaagaagaatcggtactataccaggagggacgagctgacactggcccctgatgaagtgggcacactgatctctcagcgcgagtaccggtgcgacggctattggcacgtggcaatcagcgccacccccgatgcacctcactccctgtctgagctgcgggaggccctgctgacaccacacttccccctgtacctgggcagaaagagctgtccactggccctgcctctggcagcaaggctgatgaccggcacactgaaggaggtgtttacccacgcagtggaggagatcagcgccgcagagctgtccggcttcacactgagagagggcatctgctattgggacgatcctgacgaggagtccctggtgtggcagcagaagcagcacagcaacaatcagccagtgtccagacagaggtggcagtttggcggctacaccaggttcaacggaccactgcaggagaggacataa

SEQ ID NO: 63 - DNA, 705 bp, Salmonella enterica subsp. enterica serovar Muenster strain
  misc_feature (1)..(705): Cas6
atgtatctgagcagaatccagctgaggtttaacaatctgagacccgagatgctggccaagtggaactccgccaggccttacgcctctcaccagtggctgtggcagctgttccctgagcaggagctgagacagttcctgtttagggaggaggcccacggcggcttctttatgctgagcgccatcccacccctgtcccagcactctctgtttctgatcgagaccaagcctttcaacccacagctgacaaatggcctggagctggactttcagctgagagccaaccccgtgatcacccgcaatggcaagcggtccgatgtgatgatgaacgccaagcaccaggccaaggccaatggcgtggagaaggagcggtggtgggagctgcagcagcaggcagcacaggcctggctggagcagcagggccagcagcacggctttagactgatcgccccagagcccgacgatttcgccatgtgggcaggcgacgagtacagcgagctgcaggcacactgcggatgcgtgcaggcctatcagcagcacagattcgtgaggaaggatcagcagaagccaatcaccttttcctctgtggacttctccggcgccctgtgcatcacagatgccgccctgtttaagcaggccctgttctccggcctgggcaagtctaaggccctgggctgcggcatgctgatggtgaagaggaagagataa

SEQ ID NO: 64 - protein, 511 aa, Salmonella enterica subsp. enterica serovar Muenster strain
  misc_feature (1)..(511): Cas8
MDLTKEKWLPVIFSNGEKTRISLRDLLDNRIQDLAYPRPDFQGAAWQMLIGILQCTVAPEDKEEWADIWHESIEFEQWEKALNTISLALQFGEQKPSFLQSFDPLDSEYGSIAGLLVDAPGGNALKLNKDHFVKRGNVEQICPHCAAIALFAIQTNSPAGGAGYRVGMRGGGPLTTLVVPQEEDKYPLWKKLWLNVLPQEEPPNVTQHPLIFPWLAPTKTSEKAGNVVTPDNAHPLQAYWGMPRRIELDFTHTVAGICDLCGEHHESLLLQMRSKNYGVQYDSWLHPFSPYRQALKDPSAPWLAFKGQPGGLSYKDWLGLMLNREDKFNKMQPAKVVRAAGQRNKMSLWCFAWDMDKAKVRCWYQHRIPLISVSHEEQFLAVLNIVLVLASESLSLLRNALKSAKFDCPKEAKMDFSMVDIAFWQETEPAFRTLQEALAVDPLRQDTQTRHAVSQWEAELAHYLFHVFDRDALTNPDCPDDILQRQLTARQDLASSYRKHKARKDVLALVE

SEQ ID NO: 65 - protein, 200 aa, Salmonella enterica subsp. enterica serovar Muenster strain
  misc_feature (1)..(200): Cse2
MLNSNTAVLCRILHPDAQKALLDWFATLSERYERKDGKRVNGRAWRAELKRMAPPYGVMICEGHDALRQALLKHMRLQPLDEMALALFVSVAVHIKSHKANISFAAQLGEKLKGSTPCVSVLRFERLQKASDPETFCQLLIQAVKIRGTEGVNVLSLADGIFLWMEEWQRRENHQPEFRNPFERNRIRWANEYLSTSRGK

SEQ ID NO: 66 - protein, 354 aa, Salmonella enterica subsp. enterica serovar Muenster strain
  misc_feature (1)..(354): Cas7
MIMTTFIQLHLLTAYAPANLNRDESGRPKTAFMGGVERLRVSSQSLKRAWRVSETFEAAMDGFMGKRTRRIGVDYVYRPMKDAGIEEKIAKSSSELIAKQFGKLKSDKDAKPEKNLEIEQIVHVSNHEISLIKQLVDTLIADKREPNDEEVELLRKEQRSVDMALFGRMLASSPEFNVEAACQVSHALGVSAVTVESDFFTAVDDLNNKEEDAGSGHMGEQGFASALFYTYVCISRDLLVENLGGNEELAKRTIAALTETALTVSPTGKQNSFASRAYATYALAEVGQKQPRSLAAAFFQPVRDTDQIPAAITRLKQQRASFDNVYGNCADDYRELNVQEGTGSLAELLAFVSQ

SEQ ID NO: 67 - protein, 241 aa, Salmonella enterica subsp. enterica serovar Muenster strain
  misc_feature (1)..(241): Cas5
MKEYLVFQLYAPLASWGEEASGEIRHSATVPTRSALLGLLAAALGIRRDEEARLNNFNRHYHLAVHALASQDRWLRDYHTVSAPRENKKNRYYTRRDELTLAPDEVGTLISQREYRCDGYWHVAISATPDAPHSLSELREALLTPHFPLYLGRKSCPLALPLAARLMTGTLKEVFTHAVEEISAAELSGFTLREGICYWDDPDEESLVWQQKQHSNNQPVSRQRWQFGGYTRFNGPLQERT

SEQ ID NO: 68 - protein, 234 aa, Salmonella enterica subsp. enterica serovar Muenster strain
  misc_feature (1)..(234): Cas6
MYLSRIQLRFNNLRPEMLAKWNSARPYASHQWLWQLFPEQELRQFLFREEAHGGFFMLSAIPPLSQHSLFLIETKPFNPQLTNGLELDFQLRANPVITRNGKRSDVMMNAKHQAKANGVEKERWWELQQQAAQAWLEQQGQQHGFRLIAPEPDDFAMWAGDEYSELQAHCGCVQAYQQHRFVRKDQQKPITFSSVDFSGALCITDAALFKQALFSGLGKSKALGCGMLMVKRKR

SEQ ID NO: 69 - DNA, 90 bp, Salmonella enterica subsp. enterica serovar Muenster strain
  misc_feature (1)..(90): CRISPR
gtgttccccgcgccagcggggataaaccgcagctttagcatcggtcgacagcccatctggcgtgttccccgcgccagcggggataaaccg

SEQ ID NO: 70 - DNA, 1518 bp, Atlantibacter hermannii NBRC 105704
  misc_feature (1)..(1518): Cas8
atggatttacttgttgatccatggatccctgtccgtgcgtttgaggagaggcatccacaaactattacgctacaacgattatgttgcagcgaagaaaaatggctattaaacctaccgcgcgatgacatggagctggcggccttacaattactgatctgcctgctgcaggtcacctgcgagccacgagatgacagcgaaatgcgcctaagggttgccaggccactttccgaagaagagttcgcagcattaatgtcaccctggcaccaaaccttccaacttgatcatccgcaaatgccttttatgcaggtaaaaggcgtggaagcgaaagagcccactccgatggaaaagctgatgaccggtttaagcggggcgacaaattgcgctttcgttaatcagccagggcagggcgaagcgttatgcggtggttgtacggcgatagcgctgtttaatcaggcaaataacgccccaggttttggaggcggttttaagagtggattacggggcggtacgccgattactactttaattaaaggctcagatctgcgtaccactatctggctaaatgtcctgaccacaccgcgtcttcaatcctctttcccgccagatagacttaccgaaaatcttcccacctggaaacgccctatatccagtggaaaaacatttcctgccgccacgattggtttactgcgcgggcttttttggcaacccgcacacattgaactttgcccgcctataggcccggggcaatgttgcgggtgcggacagcagagcaaccagcgttataacggttttctcaaggctaaattcaactttacggttgaaggattatggcctcatccacattccccgcgcgttctggttgagaaaaaaggcgttattgaacaaaagtttctcgcctttaccaccgcagcgccttcatggacgcaaataggtcgcctactggtggacaaagaaacccggcaaggtgaagggcgtcgggtggcgacggtggttgaacaattcagggaggtgtacccgcgcttcaggctggcattgatcgtcggtggatatcgtaataatcaggcttctattctggagcgtcgccacgatgtgctggttttcaatgatggatggcaaaacggtagcgatgtgatcaatgacattgttgaaatggggctgggatacaaaactgctttgcgaaaagggttgtacaccttcgttgagggggcaaaaaatcacgatgttaaaggggcgggtgtagcggtacacgaagtggctgaacgacattattaccgccgcagcgaactgcttattcccgcgatcctggcaagcattgattattctcagccaaatgatgtcattgcacgtctgagaaaagagcttcatcaactttgcgaagcgctcttcaaccaggttactgccccatatgcccatcatcccaaattgatccgctcattagcagtggcgcgcgcttcgcttcataaacatctcaatgaacttaaaccacaaggagagttagcgtatgtcgacggagattga

SEQ ID NO: 71 - DNA, 492 bp, Atlantibacter hermannii NBRC 105704
  misc_feature (1)..(492): Cse2
atgtcgacggagattgatgcaatggcgctctataacgcctggcagcaattagataacggctcaagtgcccagctaagacgggtaagcgagcctgatgagttacgcgagatccccgccttttatcgtctcgtccaaccctttggctgggagaatcctgccaataagcgtccgttactgcgtatggttttttgcctgagcgcgggtaaagacgtcattcatcataaagagaaaatcgatgattatccgtcaggcattagcctcggaagagcgctggcaaagagtggaaagattaacgaacgccgcgtttttcagcttgtccgtgcacagagtcccggcgacatgattcaactgcgacggttattaattcatgcagagcctgttcttgactggtctttattcgcccggcaactcacctggtggggcaaacgagagcgccagcaactgctggaagattttatgttggctacccctgaatcaaacaaaaaagcgtaa

SEQ ID NO: 72 - DNA, 1098 bp, Atlantibacter hermannii NBRC 105704
  misc_feature (1)..(1098): Cas7
atgaacaactttatcaactttcatgtcctgatttctcacagcccttcttgcctgaaccgcgacgatatgaatatgcaaaaagacgcggttttcggcggcaagcggcgtgtgcgtatttcgagccagagcttaaaacgtgcgatgcgcaaaagtgattactatgcccgtcatattggcgcatccagtcttcgcactatccatcttgaagagctgcgtgacgtattacgtcaaaaattatccccgcgattcgaattgccgataatcgataaaacgctgtctttgttatcaggaaaaaccattgatgatgctgaaaaaattaacggcgacgcagtaacgccttgggtattgggcgaagtcgaatggttttgcgaacaggtaatgaaagcggaagctgagcaactggatgataaaaaactgctcaaaatgcttaaagatgatattgccgcgatgcgcaccaatcttcagcagggggttgatgttgcactgagcggacgcatggcgaccagcggcctgatgagcgaactcgggaaagttgatggtgcaatgtccattgctcatgccatcaccacacatactgttgattccgatattgactggtttacagcagtagacgatctccaggacttaggttcggcgcaccttggaacccaggaattttcttccggcgtgttttatcgctacgccagtctgaatattgcccagcttcaggagaaccttggcggtgtatctcgcgagcaggtccttgaaatcgcagcgcatcttgcgcatatgctggcgactgaagtaccgggcgcgaagcaacataccttcgcggcattcaacccggcggacatggtcatgatcaatttttctgatttccccctttcgttagccaatgcttttgaaagcccgattaaagccaaagatggctatttgttaccttctatcaacgcctttaatgagtactggcagcgtatagctaaagggtatggattaacaggaccggcggcacagtttatgttggccgaagcaagtatggcgggcggaaatgtggtgtctgttgagacactggaacaacttaaaaaatggatttgccatgatggcgaggcgtcaagatga

SEQ ID NO: 73 - DNA, 675 bp, Atlantibacter hermannii NBRC 105704
  misc_feature (1)..(675): Cas5
atgaaaccctacttaatcctgcggcttgcgggaccgatgcaggcgtgggggcaaccaacatttgagggcacacgaccgacagcgcgcttccccacacgcagcggccttcttgggttgctgggcgcttgcctgggcattcaacgagacgaccgctcagcgttacaggcgctctctgaaagcgtcaggtttgcggttcgttgcgaccagtcatttattgatgggcgaaccattcccgttaccggcttgcgtgattaccatacggttatggatgcacgagaggattatcgtggcttaaaaagccacgaaaccattcagacctggcgcgaatacttgtgtgacgcggttttcaccgtggcggtatgggagtctgaacaggcaactctcaggctcccggagctgaaagttgcggtatgcaaacctcgttttacgccttttttgggacgtaaaagctgcccgttaacacagccgctctttgttgatctttgtgatgccatcaatccgtatcaggcgttggcaaattatgctccagcaggaggagatatttatagcgaagcgccgcctgacggaccgtgccaaacattcaccgtacgtgatgagccgattattgccttaccgcgacaatttgccgccagggagtggtacgtcataaaaggagcctcggatgtatctcagtaa

SEQ ID NO: 74 - DNA, 600 bp, Atlantibacter hermannii NBRC 105704
  misc_feature (1)..(600): Cas6
atgtatctcagtaaggtcattattcagaacgcctggtgccgggatgtttatcaatttcatcaggctatctggcagctttttccttctcaacctgcccaaaaaagagcgtttttatttcgtattgaggctaaacatcccggcagaggcgctgatgtattacttcaatcgatggaagcccctgcttcatcggctgccgcgcaagttcttgcctgtaaacctttagcatttcacctaaaagagggggatcagttgcgcttccgtctgcgtgccaacccaataaaaacgattaaagatgagcaacaacgtctgaatggtcgtggggaaatcaaacgctgccgtgtgccactacttaaagagcaggaacaacaccagtggttaatacgaaaattatcacttgcggctcgtctggaacatattgaatccactagtgagcttccgttgtttttttctaaaaatggtacgggtgggaaaattcagcccatgaattttgaaggcattcttaccgtaaccagtgtgccggcattgctgtcgctattaaataatggagtgggtccggcaaaagcaatgggatgtgggctgttatcacttgcccgcccctga

SEQ ID NO: 75 - DNA, 1518 bp, Atlantibacter hermannii NBRC 105704
  misc_feature (1)..(1518): Cas8
atggatctgctggtggacccatggattcccgtgcgggcctttgaggagaggcaccctcagaccatcacactgcagcggctgtgctgttccgaggagaagtggctgctgaatctgccaagagacgatatggagctggccgccctgcagctgctgatctgcctgctgcaggtgacctgtgagcctagggacgattctgagatgaggctgcgggtggcaaggccactgtctgaggaggagttcgccgccctgatgagcccttggcaccagacatttcagctggaccaccctcagatgccattcatgcaggtgaagggcgtggaggccaaggagccaacccccatggagaagctgatgaccggcctgagcggcgccacaaactgtgcctttgtgaatcagccaggacagggagaggccctgtgcggaggatgtacagcaatcgccctgttcaaccaggcaaacaatgcaccaggatttggaggaggcttcaagagcggcctgaggggaggaacccctatcaccacactgatcaagggctccgatctgcgcaccacaatctggctgaacgtgctgaccacaccccggctgcagtcctcttttcctccagacagactgaccgagaatctgcccacatggaagaggcctatcagctccggcaagacctttcctgcagcaacaatcggactgctgaggggactgttctggcagcctgcacacatcgagctgtgcccacctatcggaccaggacagtgctgtggatgtggacagcagtccaaccagcggtacaatggcttcctgaaggccaagtttaatttcacagtggagggactgtggcctcacccacactcccccagagtgctggtggagaagaagggcgtgatcgagcagaagtttctggccttcaccacagccgccccttcttggacccagatcggcaggctgctggtggataaggagacccgccagggagagggcaggcgcgtggccacagtggtggagcagtttcgggaggtgtaccctagattcaggctggccctgatcgtgggcggctatagaaacaatcaggccagcatcctggagcggagacacgatgtgctggtgtttaacgacggctggcagaatggctccgatgtgatcaacgacatcgtggagatgggcctgggctacaagaccgccctgaggaagggcctgtatacattcgtggagggcgccaagaatcacgacgtgaagggagcaggagtggcagtgcacgaggtggccgagcgccactactataggcgcagcgagctgctgatcccagcaatcctggcctccatcgattattctcagcctaacgacgtgatcgcaaggctgcggaaggagctgcaccagctgtgcgaggccctgttcaatcaggtgaccgcaccatacgcacaccacccaaagctgatccggtctctggcagtggcaagagccagcctgcacaagcacctgaacgagctgaagccacagggagagctggcatacgtggatggcgactaa

SEQ ID NO: 76 - DNA, 492 bp, Atlantibacter hermannii NBRC 105704
  misc_feature (1)..(492): Cse2
atgagcaccgagatcgatgccatggccctgtataacgcctggcagcagctggacaatggcagctccgcccagctgaggcgcgtgagcgagcctgatgagctgagggagatcccagccttttaccgcctggtgcagccattcggctgggagaaccccgccaataagcgccctctgctgcggatggtgttttgcctgtccgccggcaaggacgtgatccaccacaaggagaagatcgacgattacccatccggcatctctctgggacgggccctggcaaagtctggcaagatcaacgagcggagagtgttccagctggtgagagcccagagcccaggcgatatgatccagctgaggcgcctgctgatccacgcagagcccgtgctggactggagcctgtttgcaaggcagctgacctggtggggcaagagggagagacagcagctgctggaggatttcatgctggccacacccgagagcaacaagaaggcataa

SEQ ID NO: 77 - DNA, 1098 bp, Atlantibacter hermannii NBRC 105704
  misc_feature (1)..(1098): Cas7
atgaacaacttcatcaacttccacgtgctgatctctcacagcccatcctgcctgaaccgggacgatatgaatatgcagaaggatgccgtgttcggcggcaagcggagagtgagaatcagctcccagtccctgaagagagccatgaggaagtctgactactatgcaaggcacatcggagcatctagcctgcgcacaatccacctggaggagctgagagatgtgctgaggcagaagctgtcccctcgctttgagctgccaatcatcgacaagaccctgtccctgctgtctggcaagacaatcgacgatgccgagaagatcaacggcgacgcagtgaccccatgggtgctgggagaggtggagtggttctgtgagcaggtcatgaaggccgaggccgagcagctggacgataagaagctgctgaagatgctgaaggacgatatcgccgccatgaggaccaatctgcagcagggagtggatgtggccctgagcggcaggatggccacatctggcctgatgagcgagctgggcaaggtggacggagcaatgtccatcgcacacgccatcaccacacacaccgtggactctgatatcgactggtttacagccgtggacgatctgcaggatctgggctccgcccacctgggaacccaggagttttcctctggcgtgttctacagatatgcctccctgaacatcgcccagctgcaggagaatctgggaggcgtgtctcgcgagcaggtgctggagatcgcagcacacctggcacacatgctggcaaccgaggtgccaggagcaaagcagcacacatttgccgccttcaaccccgccgatatggtcatgatcaacttcagcgacttcccactgtccctggccaacgcctttgagagccccatcaaggccaaggacggctacctgctgccttccatcaacgccttcaatgagtactggcagcggatcgccaagggatatggactgaccggaccagcagcacagttcatgctggcagaggccagcatggcaggaggaaacgtggtgtccgtggagaccctggagcagctgaagaagtggatctgccacgatggagaggccagccggtaa

SEQ ID NO: 78 - DNA, 675 bp, Atlantibacter hermannii NBRC 105704
  misc_feature (1)..(675): Cas5
atgaagccatatctgatcctgagactggcaggaccaatgcaggcctggggacagcctacctttgagggcaccagaccaacagcaaggttcccaacacgctccggcctgctgggactgctgggagcatgcctgggcatccagagggacgatcggtctgccctgcaggccctgtctgagagcgtgcggtttgccgtgagatgtgatcagagcttcatcgacggccggaccatccctgtgacaggcctgagagattaccacaccgtgatggatgccagggaggactatcgcggcctgaagtctcacgagaccatccagacatggagggagtacctgtgcgacgccgtgtttaccgtggccgtgtgggagagcgagcaggccacactgaggctgccagagctgaaggtggccgtgtgcaagccccggtttacccctttcctgggcagaaagtcctgcccactgacacagcccctgttcgtggacctgtgcgacgccatcaacccttaccaggccctggcaaattatgcacctgcaggaggcgatatctattctgaggcacctccagacggaccatgccagacctttacagtgcgggacgagcctatcatcgccctgccaaggcagttcgcagcaagggagtggtacgtgatcaagggagcaagcgacgtgagccagtaa

SEQ ID NO: 79 - DNA, 600 bp, Atlantibacter hermannii NBRC 105704
  misc_feature (1)..(600): Cas6
atgtacctgagcaaagtgatcatccagaatgcctggtgtcgcgacgtgtaccagtttcaccaggccatctggcagctgttcccctctcagcctgcccagaagcgggccttcctgtttagaatcgaggcaaagcacccaggaaggggagcagacgtgctgctgcagagcatggaggcaccagcatctagcgccgcagcacaggtgctggcctgcaagcccctggcctttcacctgaaggagggcgatcagctgaggttccgcctgagggccaacccaatcaagaccatcaaggacgagcagcagcggctgaatggcagaggcgagatcaagagatgtagggtgcccctgctgaaggagcaggagcagcaccagtggctgatcaggaagctgtccctggcagcacgcctggagcacatcgagtccacctctgagctgcccctgttcttttctaagaacggcacaggcggcaagatccagcctatgaatttcgagggcatcctgaccgtgacaagcgtgcctgccctgctgtccctgctgaacaatggagtgggaccagcaaaggcaatgggatgcggcctgctgtctctggcaaggccataa

SEQ ID NO: 80 - protein, 505 aa, Atlantibacter hermannii NBRC 105704
  misc_feature (1)..(505): Cas8
MDLLVDPWIPVRAFEERHPQTITLQRLCCSEEKWLLNLPRDDMELAALQLLICLLQVTCEPRDDSEMRLRVARPLSEEEFAALMSPWHQTFQLDHPQMPFMQVKGVEAKEPTPMEKLMTGLSGATNCAFVNQPGQGEALCGGCTAIALFNQANNAPGFGGGFKSGLRGGTPITTLIKGSDLRTTIWLNVLTTPRLQSSFPPDRLTENLPTWKRPISSGKTFPAATIGLLRGLFWQPAHIELCPPIGPGQCCGCGQQSNQRYNGFLKAKFNFTVEGLWPHPHSPRVLVEKKGVIEQKFLAFTTAAPSWTQIGRLLVDKETRQGEGRRVATVVEQFREVYPRFRLALIVGGYRNNQASILERRHDVLVFNDGWQNGSDVINDIVEMGLGYKTALRKGLYTFVEGAKNHDVKGAGVAVHEVAERHYYRRSELLIPAILASIDYSQPNDVIARLRKELHQLCEALFNQVTAPYAHHPKLIRSLAVARASLHKHLNELKPQGELAYVDGD

SEQ ID NO: 81 - protein, 163 aa, Atlantibacter hermannii NBRC 105704
  misc_feature (1)..(163): Cse2
MSTEIDAMALYNAWQQLDNGSSAQLRRVSEPDELREIPAFYRLVQPFGWENPANKRPLLRMVFCLSAGKDVIHHKEKIDDYPSGISLGRALAKSGKINERRVFQLVRAQSPGDMIQLRRLLIHAEPVLDWSLFARQLTWWGKRERQQLLEDFMLATPESNKKA

SEQ ID NO: 82 - protein, 365 aa, Atlantibacter hermannii NBRC 105704
  misc_feature (1)..(365): Cas7
MNNFINFHVLISHSPSCLNRDDMNMQKDAVFGGKRRVRISSQSLKRAMRKSDYYARHIGASSLRTIHLEELRDVLRQKLSPRFELPIIDKTLSLLSGKTIDDAEKINGDAVTPWVLGEVEWFCEQVMKAEAEQLDDKKLLKMLKDDIAAMRTNLQQGVDVALSGRMATSGLMSELGKVDGAMSIAHAITTHTVDSDIDWFTAVDDLQDLGSAHLGTQEFSSGVFYRYASLNIAQLQENLGGVSREQVLEIAAHLAHMLATEVPGAKQHTFAAFNPADMVMINFSDFPLSLANAFESPIKAKDGYLLPSINAFNEYWQRIAKGYGLTGPAAQFMLAEASMAGGNVVSVETLEQLKKWICHDGEASR

SEQ ID NO: 83 - protein, 224 aa, Atlantibacter hermannii NBRC 105704
  misc_feature (1)..(224): Cas5
MKPYLILRLAGPMQAWGQPTFEGTRPTARFPTRSGLLGLLGACLGIQRDDRSALQALSESVRFAVRCDQSFIDGRTIPVTGLRDYHTVMDAREDYRGLKSHETIQTWREYLCDAVFTVAVWESEQATLRLPELKVAVCKPRFTPFLGRKSCPLTQPLFVDLCDAINPYQALANYAPAGGDIYSEAPPDGPCQTFTVRDEPIIALPRQFAAREWYVIKGASDVSQ

SEQ ID NO: 84 - protein, 199 aa, Atlantibacter hermannii NBRC 105704
  misc_feature (1)..(199): Cas6
MYLSKVIIQNAWCRDVYQFHQAIWQLFPSQPAQKRAFLFRIEAKHPGRGADVLLQSMEAPASSAAAQVLACKPLAFHLKEGDQLRFRLRANPIKTIKDEQQRLNGRGEIKRCRVPLLKEQEQHQWLIRKLSLAARLEHIESTSELPLFFSKNGTGGKIQPMNFEGILTVTSVPALLSLLNNGVGPAKAMGCGLLSLARP

SEQ ID NO: 85 - DNA, 90 bp, Atlantibacter hermannii NBRC 105704
  misc_feature (1)..(90): CRISPR
gtgttccccgcgccagcggggataaaccgttttaaaacaggatgtggcccgcctggtgctggtgttccccgcgccagcggggataaaccg

SEQ ID NO: 86 - DNA, 1512 bp, Geothermobacter sp. EPR-M
  misc_feature (1)..(1512): Cas8
atgaatctattgaccgatccgtggataccggcacggccccaaggcagggcgacagcgcagaagttgaccttgcgacagctgctgtgtgaagacgaacgctgggagttgcgtctgccacgtgatgacatggagatggcaacactgcaattgctgatctgcctgacccaggcgttggcaacgccggcagatttgccggagctgaaacgacgaattatgaagcctttgggacagcaggagttcaatgccgcctacactcctttcgcggactggttccggctcgatcatccgcagtatccgttcatgcaggtgcggggagtgaaggcgaaggagccgacgccgatggataaactgctggccgggttgacgggggcgaccaacagctgtttcgtcaaccaatcgggattgggcgaggggctttgcccggcttgcgctgctatcgctttgtttaaccaggcgatgaatgtccctggattcggtgggggattcaaagccagtttgcgcggcagtgctccggtcaccacactggtacaaggcgaacacctgcggcaaaccatctggttgaatgtgctgagcacggagtcggtcgaagctctgcttccctggcatcggcaaacggaagaccagaaaccgacctggatagctccaatcaaatccgaaaccttttcatcccgaagtatcgggtttctgcggggtctgttctggcagccggcgcacattgagttgctgcccgctgagtcggtcggagattgcagttgctgcggtcagggggacacggaagtgtatcgcggattcaataaggcgaaattcaattacaccgtgaccggcatttggccgcatcctcatggggcgagaacctctactgtgaaaaagggggaacaggaagagaagttcgtttctttcaccaccgaagctccctcctggactcagttgggtcgtttcgtggcacgccgtgcctttgttgacgccaaaactcccggtcaggaaccggcggcggtgatccgtcaggcgcaaaaacttggtgtgcggttgactctctgcatcggtggatatcgcaacaaccaagcctcgattctggagcgacggcatgagttgctaccccttggcgaggggtggaattcgaaaccccagattgttcaggatgttgtggatactgccatcggctatcgcgatgcgctgaacaagtcactgtattcctttttcaagggaggagggagcaagggcgccgggctgccgatccatgaattcggcaaggcccaattctaccgccgaacggaagaagccatcctcgacagcttggctcgtctcgatttcagtaatccacgtccggttctactcgcgcttcagaaaaaactggatacagaggtcaggggactgtttgaggaagcggtccgtccctatctgaacgaccccaacctgattcataccatggcggtttcccgccggactttatacaaaaatctcaacgtactgaaacctcaacaggagggaggagtcgatggcaaaagaaactga

SEQ ID NO: 87 - DNA, 480 bp, Geothermobacter sp. EPR-M
  misc_feature (1)..(480): Cse2
atggcaaaagaaactgattttatggatctgtatcaggcctggcagcgattgccgaacgggccaaaagccgagcttaagcgatgcggcgacttgggtgatctgcttgaaacctcggcgttttatcgtctgctcgccgggcggggtgaagcggaatggcagaagaaagcttatcagcgcatgatcttctgcctcccctgcatcaaccacacggaacagaaaatccctctgggcgctgcgctggcgagaagtcgcaaggggagccggtcggcggtttcagaaagccgtatgattcaagttgtgcgcagcgaagcgccgaacgacatggttcagttgcggcggattctcaagcacgccgaaccgacagtcaactggccgctgatggcaaaacagctttggtactgggatctcaacgaacgcagtaaacggagtttgctcgaagatttctttctcaatcacaccgacacatcaaaggagggttaa

SEQ ID NO: 88 - DNA, 1095 bp, Geothermobacter sp. EPR-M
  misc_feature (1)..(1095): Cas7
gtgcagaatttcatcaactatcacgttctcatttcgcacagtccgtcttgcctcaaccgcgacgacatgaatatgcagaagtcagccatcttcggtggtgtgcgccgagtacggatttcaagccagagtctgaaacgggcgatgcgtaaaagcgactattatgctcagcaccttggtgaagcgagtatccgcacaaagcatttgagtggactgcgggatcggttgcacgaaaggctggcggggcgtttttctcccgaagttatcgataaaactatcaagctgctcatcgacaaggacgtttccgtcgatggaatcgtcgaaggcgatgccgtggccccttgggcggtggaagagtttgcctggttctgcgagcgggttatgaatgcgcaggcggaagggctggaagacaaggctctgaccaagcagttgaaagaatctatcgccgcgatgcgacagacgctggttggcgggcttgatatcgcattatccgggcggatggccacctcggggttgctcagtgaacttggcaaggtcgatggtgcgctggccgtggcgcatgccttgaccacccacacggttgatgccgatatcgactggttcaccgctgtggatgatctgcaggaactgggatctgggcacctcgacacccaggaattctctagtggggtgttctatcgctacgccagtctgaacatcggccagttgcaggaaaacctcggtggcgcaccacgcgaacaggcgctggagattgccacgcacgtattgcagatgttggcgacggtagttccgtctgctaagcagcagagttttgccgcgcacaaccttgctgacttggcgttggtttccttcgccgatatcccggtatcgctggccaatgccttcgaaaaaccggtgcagcagaaaaacggcagtggattccgtgaaccttcgattgctgcgctgcacgactattggcagaaggtgcatatcggctacgggctggaagaacgctgcgggcagtttgttttgaacaaagtggaaacgcctgccgggatcgctgcgaaagagagccttgaggacctcaaaagttgggtgcgcaacaacggagaggggtga

SEQ ID NO: 89 - DNA, 678 bp, Geothermobacter sp. EPR-M
  misc_feature (1)..(678): Cas5
atgggcgactacctgattctgaaactgcaggggccgatgcaggcctggggggagcacagctttgaagggacgcgcccttcgggcaacttcccgacccgtagtgccctgctcggacttcttggtgcctgtctcggcattcgccggaatgaatacgaacgtttgcagcaattggcggacagcgttcaatttgccgtgcgtaaagatgctcgccagacgcaaaccgagtggggggagccgaaaaagctgccgatggtcaagatgactgattaccacaccgtcaaggacgcacggcagagttacattggcctcaaaagccacgaaaccattcagacctggcgggaatatctgcttgatgcggaatacagcgttgctatctgggaaaacgaggatgcagccgtgtcactggatgaattggaaacggccgtgcgcaaaccggtattcaccccttatcttgggcgacggagctgtccgttggcgcaaccgctgtttggcaaaaggcttaccgcggaaagtccgaaccaggccttgcaggctgttgaaccgagcggcggtgtgatttacagcgaacagccatcagatcgcagcatgcgcctgcgtgacctgccgatggcgggtcaaccacgccagttcgcttcccgcaccgtctacatccacggaggggatcatgtatctgagtaa

SEQ ID NO: 90 - DNA, 609 bp, Geothermobacter sp. EPR-M
  misc_feature (1)..(609): Cas6
atgtatctgagtaaggttatggtgactggggccgcctgtcgcaatccctatgaaatccaccgcagcctctggcaactgtttccagaagatcccgacgccaggcgagactacttgtttcgcgtagagcgcgccgggcggcagcaggctgaaatcttgttacagtcgcagcgaaaaccgagcgattcagagttgcgtaaggtccgactgctggcgacgcgagggtatcaaccgaggctgcagcaggggcaacggctgcgttttgcgttgctggccaacccggtcaagaccatcaacgatgaacgcggccgcctgaatgccaaaggccaggtgaaaaaatgccgggttccgctgattcgcgaggaggaatggcggagctggttggagcacaagctgattggttgtgcggagctggagacgctggtcgctgaaaatcgtctgccgataaatttccgcaagcccaaggaaaaacgtgtcgggaaaattcagccggtcagttttcaggggattttacgggtatctagcccggaagctatgatgcaggcaatctctaccggcatcggcccggctaaagccttcggttgcggcctgctgtcaatcgcccctgcgtga

SEQ ID NO: 91 - DNA, 1512 bp, Geothermobacter sp. EPR-M
  misc_feature (1)..(1512): Cas8
atgaacctgctgacagatccctggattcccgcaaggccacagggaagggcaaccgcacagaagctgacactgagacagctgctgtgcgaggacgagaggtgggagctgagactgcccagggacgatatggagatggccaccctgcagctgctgatctgtctgacccaggccctggcaacaccagcagatctgcccgagctgaagcggagaatcatgaagcccctgggccagcaggagtttaatgccgcctacaccccttttgccgattggttccgcctggaccacccccagtatcctttcatgcaggtgcggggagtgaaggcaaaggagccaacacccatggacaagctgctggcaggactgaccggagcaacaaacagctgttttgtgaatcagtccggcctgggagagggactgtgcccagcctgtgccgccatcgccctgttcaaccaggccatgaatgtgcctggctttggaggaggcttcaaggcctctctgaggggcagcgccccagtgaccacactggtgcagggagagcacctgaggcagaccatctggctgaacgtgctgtctacagagagcgtggaggccctgctgccatggcacaggcagaccgaggaccagaagcccacatggatcgcccctatcaagagcgagaccttcagctccagatccatcggctttctgaggggactgttctggcagccagcacacatcgagctgctgcctgcagagagcgtgggcgattgctcctgctgtggccagggcgacacagaggtgtacaggggctttaacaaggccaagttcaattataccgtgacaggaatctggcctcacccacacggagcacgcaccagcacagtgaagaagggcgagcaggaggagaagttcgtgagcttcaccacagaggcacctagctggacccagctgggccgctttgtggcaaggagggccttcgtggatgcaaagacacctggacaggagccagcagccgtgatcaggcaggcacagaagctgggcgtgcggctgaccctgtgcatcggaggctataggaacaatcaggccagcatcctggagcggagacacgagctgctgccactgggagagggatggaattccaagccccagatcgtgcaggatgtggtggacacagccatcggctaccgcgacgccctgaacaagtccctgtattctttctttaagggaggaggctccaagggagcaggactgcctatccacgagtttggcaaggcccagttctacaggcgcaccgaggaggccatcctggattccctggccagactggacttttctaatcccaggcctgtgctgctggccctgcagaagaagctggatacagaggtgagaggcctgttcgaggaggccgtgaggccatacctgaacgaccccaatctgatccacaccatggccgtgagccggagaacactgtataagaacctgaatgtgctgaagccacagcaggagggaggagtggacggcaagagaaactaa

SEQ ID NO: 92 - DNA, 480 bp, Geothermobacter sp. EPR-M
  misc_feature (1)..(480): Cse2
atggccaaggagacagatttcatggacctgtaccaggcctggcagagactgccaaacggaccaaaggcagagctgaagaggtgcggcgatctgggcgacctgctggagaccagcgccttttacagactgctggcaggaaggggagaggcagagtggcagaagaaggcctatcagcggatgatcttctgcctgccctgtatcaatcacacagagcagaagatccctctgggagccgccctggcacggagcagaaagggcagccggagcgccgtgagcgagtctaggatgatccaggtggtgcgctccgaggcaccaaacgatatggtgcagctgaggcgcatcctgaagcacgcagagccaaccgtgaactggcctctgatggccaagcagctgtggtactgggacctgaatgagaggagcaagcggagcctgctggaggatttctttctgaaccacaccgacacaagcaaggagggataa

SEQ ID NO: 93 - DNA, 1095 bp, Geothermobacter sp. EPR-M
  misc_feature (1)..(1095): Cas7
atgcagaactttatcaattaccacgtgctgatctctcacagcccatcctgcctgaaccgcgacgatatgaatatgcagaagagcgccatcttcggaggcgtgcggagagtgcggatcagctcccagagcctgaagcgggccatgagaaagtccgactactatgcccagcacctgggcgaggcctctatcagaaccaagcacctgagcggcctgagggataggctgcacgagcgcctggcaggccggttcagccccgaagtgatcgacaagacaatcaagctgctgatcgacaaggatgtgagcgtggatggaatcgtggagggcgacgcagtggcaccatgggcagtggaggagtttgcatggttctgtgagagagtgatgaacgcacaggcagagggcctggaggataaggccctgaccaagcagctgaaggagtccatcgccgccatgagacagacactggtgggcggcctggatatcgccctgtctggcaggatggccaccagcggcctgctgtccgagctgggcaaggtggacggcgccctggcagtggcacacgccctgaccacacacaccgtggacgccgatatcgactggtttacagccgtggacgatctgcaggagctgggctctggccacctggacacccaggagttttctagcggcgtgttctacagatatgccagcctgaacatcggacagctgcaggagaatctgggaggagcaccaagggagcaggccctggagatcgcaacccacgtgctgcagatgctggccacagtggtgccctccgccaagcagcagtctttcgccgcccacaatctggccgatctggccctggtgtcctttgccgacatccccgtgagcctggcaaacgccttcgagaagccagtgcagcagaagaatggctctggctttcgggagccaagcatcgccgccctgcacgactactggcagaaggtgcacatcggctatggcctggaggagagatgcggccagttcgtgctgaacaaggtggagacccctgcaggaatcgcagcaaaggagtccctggaggatctgaagtcttgggtgcgcaacaatggagagggataa

SEQ ID NO: 94 - DNA, 678 bp, Geothermobacter sp. EPR-M
  misc_feature (1)..(678): Cas5
atgggcgactatctgatcctgaagctgcagggacctatgcaggcctggggagagcacagctttgagggaacccgcccatccggcaatttccccacacggtctgccctgctgggactgctgggagcatgtctgggcatccggcggaacgagtacgagaggctgcagcagctggccgatagcgtgcagtttgccgtgagaaaggacgccaggcagacccagacagagtggggcgagccaaagaagctgcccatggtgaagatgaccgattaccacacagtgaaggacgccagacagtcttatatcggcctgaagagccacgagaccatccagacatggagggagtacctgctggacgccgagtattctgtggccatctgggagaatgaggatgcagccgtgagcctggacgagctggagaccgccgtgaggaagcccgtgttcaccccatacctgggcaggcgcagctgcccactggcacagcctctgttcggcaagcgcctgaccgcagagtccccaaaccaggccctgcaggcagtggagccttccggcggcgtgatctattctgagcagccctctgatcgcagcatgaggctgagggacctgcctatggcaggacagccaaggcagttcgcatctcggaccgtgtacatccacggaggcgatcacgtgtccgagtaa

SEQ ID NO: 95 - DNA, 609 bp, Geothermobacter sp. EPR-M
  misc_feature (1)..(609): Cas6
atgtacctgagcaaagtgatggtgaccggagcagcatgtaggaacccatatgagatccaccggtccctgtggcagctgttccccgaggaccccgacgcacggagagattatctgttccgggtggagagagcaggcaggcagcaggcagagatcctgctgcagagccagcggaagccaagcgactccgagctgcgcaaggtgcggctgctggcaaccagaggataccagccaaggctgcagcagggacagcggctgagatttgccctgctggccaaccctgtgaagacaatcaatgatgagaggggccgcctgaacgcaaagggacaggtgaagaagtgcagggtgccactgatcagggaggaggagtggagaagctggctggagcacaagctgatcggatgtgcagagctggagaccctggtggcagagaacaggctgcccatcaacttcagaaagccaaaggagaagagggtgggcaagatccagcccgtgagcttccagggcatcctgagagtgtcctctccagaggccatgatgcaggccatctctaccggcatcggaccagcaaaggccttcggctgcggactgctgagcatcgcaccagcataa

SEQ ID NO: 96 - protein, 503 aa, Geothermobacter sp. EPR-M
  misc_feature (1)..(503): Cas8
MNLLTDPWIPARPQGRATAQKLTLRQLLCEDERWELRLPRDDMEMATLQLLICLTQALATPADLPELKRRIMKPLGQQEFNAAYTPFADWFRLDHPQYPFMQVRGVKAKEPTPMDKLLAGLTGATNSCFVNQSGLGEGLCPACAAIALFNQAMNVPGFGGGFKASLRGSAPVTTLVQGEHLRQTIWLNVLSTESVEALLPWHRQTEDQKPTWIAPIKSETFSSRSIGFLRGLFWQPAHIELLPAESVGDCSCCGQGDTEVYRGFNKAKFNYTVTGIWPHPHGARTSTVKKGEQEEKFVSFTTEAPSWTQLGRFVARRAFVDAKTPGQEPAAVIRQAQKLGVRLTLCIGGYRNNQASILERRHELLPLGEGWNSKPQIVQDVVDTAIGYRDALNKSLYSFFKGGGSKGAGLPIHEFGKAQFYRRTEEAILDSLARLDFSNPRPVLLALQKKLDTEVRGLFEEAVRPYLNDPNLIHTMAVSRRTLYKNLNVLKPQQEGGVDGKRN

SEQ ID NO: 97 - protein, 159 aa, Geothermobacter sp. EPR-M
  misc_feature (1)..(159): Cse2
MAKETDFMDLYQAWQRLPNGPKAELKRCGDLGDLLETSAFYRLLAGRGEAEWQKKAYQRMIFCLPCINHTEQKIPLGAALARSRKGSRSAVSESRMIQVVRSEAPNDMVQLRRILKHAEPTVNWPLMAKQLWYWDLNERSKRSLLEDFFLNHTDTSKEG

SEQ ID NO: 98 - protein, 364 aa, Geothermobacter sp. EPR-M
  misc_feature (1)..(364): Cas7
MQNFINYHVLISHSPSCLNRDDMNMQKSAIFGGVRRVRISSQSLKRAMRKSDYYAQHLGEASIRTKHLSGLRDRLHERLAGRFSPEVIDKTIKLLIDKDVSVDGIVEGDAVAPWAVEEFAWFCERVMNAQAEGLEDKALTKQLKESIAAMRQTLVGGLDIALSGRMATSGLLSELGKVDGALAVAHALTTHTVDADIDWFTAVDDLQELGSGHLDTQEFSSGVFYRYASLNIGQLQENLGGAPREQALEIATHVLQMLATVVPSAKQQSFAAHNLADLALVSFADIPVSLANAFEKPVQQKNGSGFREPSIAALHDYWQKVHIGYGLEERCGQFVLNKVETPAGIAAKESLEDLKSWVRNNGEG

SEQ ID NO: 99 - protein, 225 aa, Geothermobacter sp. EPR-M
  misc_feature (1)..(225): Cas5
MGDYLILKLQGPMQAWGEHSFEGTRPSGNFPTRSALLGLLGACLGIRRNEYERLQQLADSVQFAVRKDARQTQTEWGEPKKLPMVKMTDYHTVKDARQSYIGLKSHETIQTWREYLLDAEYSVAIWENEDAAVSLDELETAVRKPVFTPYLGRRSCPLAQPLFGKRLTAESPNQALQAVEPSGGVIYSEQPSDRSMRLRDLPMAGQPRQFASRTVYIHGGDHVSE

SEQ ID NO: 100 - protein, 202 aa, Geothermobacter sp. EPR-M
  misc_feature (1)..(202): Cas6
MYLSKVMVTGAACRNPYEIHRSLWQLFPEDPDARRDYLFRVERAGRQQAEILLQSQRKPSDSELRKVRLLATRGYQPRLQQGQRLRFALLANPVKTINDERGRLNAKGQVKKCRVPLIREEEWRSWLEHKLIGCAELETLVAENRLPINFRKPKEKRVGKIQPVSFQGILRVSSPEAMMQAISTGIGPAKAFGCGLLSIAPA

SEQ ID NO: 101 - DNA, 90 bp, Geothermobacter sp. EPR-M
  misc_feature (1)..(90): CRISPR
ctgttccccgcacccgcggggatgaaccggtcatctatttttaatggacgatatttttcaactgttccccgcacccgcggggatgaaccg

SEQ ID NO: 102 - DNA, 1509 bp, Methylocaldum sp. 14B
  misc_feature (1)..(1509): Cas8
atgaatctgcttgaagacccttggattcccgtgcgtgccgatggcggtacgggcgctttccaactgctgacctatcggcagctactttgcgaacccggcaactggcaggtgagcttgccgcgtgacgatctggagctggcctgtgtgcaattgctggtgtgcatgactcaggtgatgttcttgccggaaaacgacgctgtttggcggaagcggttgactgaagctttgacgcgtgaagagttcaccgccggcacagaaccgtgcctggattggttcgatctcgaccacccgacccagcctttcatgcaatcacgaggagtgagggccgccgaggacacgcccattcagaagctgctgattggcctgccggaaggaaacaaccacgctttcttcaacgaggcgggcgaagtgcgccacctatcggtaacagtggcagcaattgccctgttcaatcaggctactaattgccccagtttcggcggcggcttcaagggcagcctacgtggaggcgcgccaatcaccacactggtgaatggcgagaatttgcgcgaaaccgtctggtgtaatgtactcacacgctcccgtttggctgcgcgccagatcgccatgcccggattggatcgggaccgtccaacctgggtcgagcctatccaggaaaaagccaccattccctggaacaccatcggtttggcgcgaggcttgttttggcagccggcgcgggtggaactggtgaggtccatggccgctgcaccttgcgatgtgatgggcggcgcgcccacattgggatacgtgggatttcgcaaggagaaattcaactttaccgtggagggagtgtggccccaccctcatggcgcaataaccatgaccttgaaaaaaggcgcgcttgaacaaaagttcgccagcttcacgaccaccgcgccggcatggacccagctctccgaattcgtcgtgcccaaaggcgtcaatgatcccggagccaaagagggctccattcccgcaggaccggttacacaagccagcgagctaggcgaaagcggtttacacctgctcgttggcggctatcgcaccaatcaagcttccgtgttggaacggcgccacgaaatgatgagcctggcccgaggctggcgggatgacaaaagccgcctgcccaaattggtcgaaatgggcaaagaggcaaaaaaagccttgcgcggcaagctctatttcgccgttcagggcaataaagacaaagggcttaaaggtattggcgcggccatccacgaaaccgccgagaaactgttttacgcccgaaccgaaagtctgatccacgaaaccttttccaatgaactcacgttcaagcagtgggccaccgcccgcaaggcttttgtccaggaattggccggccattgccgcgcaatttttgaggagctgactgcaccttatgcgatgaaaccggagttgattccggttatcgcctgggcgcggcgcagcctgaatttcgatcttaccaagctgatggaggatgcatga

SEQ ID NO: 103 - DNA, 456 bp, Methylocaldum sp. 14B
  misc_feature (1)..(456): Cse2
atgactgccgaattgccggattttgtcgcgctgaaaatgcactacgacgacgagagctttccgaccggcgcacgtgccgagctgcgccgtgctgccgaaccggatgatgtggcgttgaccccggcgctctaccgcttattccccggcgagcggccgagcgaccgccacttacgtgtcgcctatctcctgccctatgccaaacacgcggctaaagccaagtcgttgggtgcgcaactggcggaagccaaggtggcggaagcacgggttctgcaagtggcccgcgctcatgaaccgctcgatgtggtccagttacgtcgcctcttgatgcaggttgaagccgcagtggactggtcggcgttcggcccgatggtgtggttttggaacgaacgagccaaacgtcagctcatcgaggatttctatatcgcccgtttttcccccgtcacaggagctaaataa

SEQ ID NO: 104 - DNA, 1137 bp, Methylocaldum sp. 14B
  misc_feature (1)..(1137): Cas7
atgaccaagaagaacttcatcaacttccatgtactcatttcccacagcccctcctgtctcaaccgggacgatatgaacatgcagaaaaccgccgtatttggtggcgtcaaccgggtgcggatttccagccaatctctgaagcgggcgatacgcaagagcgattactaccaagccaatttgggcgcaccatcggtgcgcacccgcgatttgaacaaactcaaagcgcgtttcaccgaactgctcaaagaccgctttgacgccgaattgattaaccgcgcgctggagtggatttccggcaaggaaggtatcgccgaaggcgtaacggccgacgccgttgcgccctggtcggtggatgaagtaacgcacttctgcgaaatcattagcgccgacgaccagcaagatatcaagaaactggaaaagcagattgaaaaagaggcgcgtcctttccgggcggctatgagcaacaccgtggacatcgccttgtccggtcgtatggcgaccagtggattgatgagcaacctgcccgtggatggcgcgctcgccgtcgctcacgccattaccacccatgccgtcgagccgcaggacgtggactggttcaccgccgtcgacgatttgacccaggacgcgggcgatacgggagcgggacatctggatacccagcagttttcctccggcgtgttctaccgttacgccagtctcaacctgagacaactgcaagtgaacctgggattgatcgaccacatcaaggcggaggaaaccgccgagtcccgccaacgtgcgctggacatcgcccatcatgtattccatttactggcgacggtggtgccttcggccaagcaacagtctttcgccgctcacaacttggcggacttcgccatcgtcagcttcgccgaccagccgatttcgttagccaatgcattcgaagaaccggtcagacgcgattacaaactggcgggattcctcaaaccatccattcagtgtttggccaattactggggacgcatgaatcgcgcctacggtctggacgaacaggcgcgcgctttcgcggtcgatgcgagcttcgagatgggcggcaagcctcccctggactccctgaaagcggtggaagactggatcgccgaggatggtcaggaataa

SEQ ID NO: 105 - DNA, 681 bp, Methylocaldum sp. 14B
  misc_feature (1)..(681): Cas5
atgccgcgttatttgattctcctcctggacggtcccatgcaagcgtggggcacgcacacgttcgaagattttcgcccttgcaatgcgtttccgactcgcagcggtttgctcggactgctaggtgcctgcctggggttggaccggcgcgataccgaagcattggagcaattggcgatgagcgtcgagttcgccgtacgcgccgacagagaggtgttgcggccggaagcggaagtacccaaggcaaaagccgctgtaaagcttcccgacttccacacggtggaggatgctcgcaaggtagacggttccgccaacaagaacccggtggtttctcggcgcgaatacctgttcgatgccgctttcaccgtggcgatcggcgcaaagcccgacgggccggttacgctggatgcaattgccgaagctttgcggcgcccgtgttttacgcctgtgctgggacggcgttcctgtcccatcgcccggcctttgctcgatggcgaggccgtggaggcgagcgatgcgaaggcggcactggcaaccatcgcacctgtaggtggcatgatctataccgaaggcgaattgatctccgcacaacccttgcgggtccgcgacgtacccatacagggccggcaccggcaattcagcactcgactggtgtatctccataagggggaaacatgttcctga

SEQ ID NO: 106 - DNA, 627 bp, Methylocaldum sp. 14B
  misc_feature (1)..(627): Cas6
atgttcctgagccgtgtcgagattccttgggatgcagtccgcaacccttacgaaattcatcgccagctttggcggctgtttcccggagaggacaaagaaccccggaagaatgccgaggaaggacgccaagggttcctgttcagggtggaaaacaatcagcctggccgcccgctgcgtttgttgattcagtctcggcgagcgccagagcctacggctggattgacgattgtaggtacgcgcgaattccaaccccagccagctcacgggcagcgcttggcatttctactcacctcaaatccggtcaaaaccattatcgatgcacagcgagaaaccaagtcgggcaaaagctccgaaaagtgccgtgtgccgttgattcacgaatccgaacagcgcgaatggttaaagcgcaaactcatcggtgcgggagaatttgaaggtgtcaatgtggtgcctcacgccccggtgttctttcggaaaggcaatcggggcggcaagatagtcatggtgactttcgaaggcgtattgcgtgtaaacgagccaggaacgttgatcgcctatttggaaaacggcatcggccccgccaaagccttcggttgcggtttgctgttagtacggcgcttgggataa

SEQ ID NO: 107 - DNA, 1509 bp, Methylocaldum sp. 14B
  misc_feature (1)..(1509): Cas8
atgaatctgctggaggacccttggattcccgtgcgggcagatggaggaaccggagcattccagctgctgacatacaggcagctgctgtgcgagccaggaaactggcaggtgagcctgccaagggacgatctggagctggcctgcgtgcagctgctggtgtgcatgacccaggtcatgtttctgcctgagaatgacgccgtgtggaggaagcgcctgaccgaggccctgacaagagaggagttcacagccggcaccgagccatgtctggactggtttgacctggatcaccccacccagcctttcatgcagtctaggggcgtgcgcgcagcagaggatacaccaatccagaagctgctgatcggcctgcctgagggcaacaatcacgccttctttaatgaggcaggagaggtgcggcacctgagcgtgaccgtggccgccatcgccctgttcaaccaggccacaaattgcccttcctttggcggaggcttcaagggctctctgaggggaggagcaccaatcaccacactggtcaacggcgagaatctgcgggagaccgtgtggtgtaacgtgctgacacggtccagactggcagcaaggcagatcgcaatgccaggcctggacagggataggcctacctgggtggagccaatccaggagaaggccaccatcccctggaatacaatcggactggcaaggggactgttttggcagcctgcccgggtggagctggtgagaagcatggcagcagcaccttgcgacgtgatgggaggagcaccaaccctgggatatgtgggcttcagaaaggagaagtttaacttcacagtggagggcgtgtggccacacccacacggagccatcacaatgaccctgaagaagggcgccctggagcagaagtttgccagcttcaccacaaccgcacctgcatggacccagctgtccgagttcgtggtgccaaagggagtgaacgatccaggagcaaaggagggctccatcccagcaggaccagtgacccaggcctccgagctgggagagtctggcctgcacctgctggtgggaggatacaggacaaatcaggccagcgtgctggagcggagacacgagatgatgtccctggcccggggctggagagacgataagagccggctgccaaagctggtggagatgggcaaggaggccaagaaggccctgaggggcaagctgtattttgccgtgcagggcaacaaggacaagggcctgaagggaatcggagcagcaatccacgagaccgccgagaagctgttctacgccagaacagagtctctgatccacgagaccttcagcaatgagctgaccttcaagcagtgggccacagccagaaaggcctttgtgcaggagctggcaggacactgtagggcaatcttcgaggagctgaccgccccctacgccatgaagcctgagctgatcccagtgatcgcatgggcaaggcgcagcctgaacttcgacctgacaaagctgatggaggatgcctaa

SEQ ID NO: 108 - DNA, 456 bp, Methylocaldum sp. 14B
  misc_feature (1)..(456): Cse2
atgacagcagagctgccagattttgtggccctgaagatgcactatgacgatgagtccttccccaccggagcaagggcagagctgaggcgcgcagccgagcctgacgatgtggccctgacaccagccctgtacaggctgtttcctggagagaggccatctgacaggcacctgcgcgtggcatacctgctgccctatgccaagcacgccgccaaggccaagagcctgggagcacagctggcagaggcaaaggtggccgaggcccgggtgctgcaggtggccagagcacacgagcccctggacgtggtgcagctgcggagactgctgatgcaggtggaggcagcagtggattggtccgcctttggccctatggtgtggttctggaacgagcgggccaagagacagctgatcgaggacttttatatcgcccgcttctctccagtgaccggagcaaagtaa

SEQ ID NO: 109 - DNA, 1137 bp, Methylocaldum sp. 14B
  misc_feature (1)..(1137): Cas7
atgaccaagaagaactttatcaatttccacgtgctgatcagccactccccttcttgcctgaacagagacgatatgaatatgcagaagacagccgtgttcggcggcgtgaatcgggtgagaatcagctcccagtccctgaagcgggccatcagaaagtctgactactatcaggccaacctgggagcaccaagcgtgaggacccgcgatctgaataagctgaaggcccggtttacagagctgctgaaggacagattcgatgccgagctgatcaacagggccctggagtggatctccggcaaggagggcatcgcagagggagtgaccgcagacgcagtggccccatggtctgtggatgaggtgacacacttttgtgagatcatcagcgccgacgatcagcaggacatcaagaagctggagaagcagatcgagaaggaggcaaggcccttccgcgcagcaatgagcaacaccgtggacatcgccctgtccggcaggatggccacatctggcctgatgagcaatctgccagtggatggcgccctggcagtggcacacgcaatcaccacacacgccgtggagcctcaggacgtggattggttcaccgccgtggacgatctgacacaggacgcaggcgataccggagcaggacacctggatacccagcagttttctagcggcgtgttctacagatatgcctccctgaacctgcgccagctgcaagtgaatctgggcctgatcgaccacatcaaggcagaggagaccgcagagtctcggcagagagccctggatatcgcccaccacgtgtttcacctgctggccacagtggtgccttccgccaagcagcagtctttcgccgcccacaacctggccgactttgccatcgtgagcttcgccgatcagccaatctccctggccaatgcctttgaggagcccgtgcggagagactacaagctggccggcttcctgaagccatccatccagtgcctggccaactactggggccggatgaatagagcatatggcctggacgagcaggcaagggcctttgccgtggatgccagcttcgagatgggcggcaagccccctctggattccctgaaggccgtggaggactggatcgccgaggatggacaggagtaa

SEQ ID NO: 110 - DNA, 681 bp, Methylocaldum sp. 14B
  misc_feature (1)..(681): Cas5
atgcctcggtacctgatcctgctgctggacggaccaatgcaggcctggggaacacacacctttgaggatttcagaccctgcaacgccttccctaccaggagcggcctgctgggactgctgggagcctgtctgggcctggacaggcgcgatacagaggccctggagcagctggccatgtccgtggagtttgccgtgagggcagacagggaggtgctgaggccagaggcagaggtgccaaaggcaaaggcagcagtgaagctgccagatttccacaccgtggaggacgcccgcaaggtggatggctctgccaacaagaatcccgtggtgagccggagagagtatctgtttgacgcagccttcaccgtggcaatcggagcaaagcctgacggaccagtgacactggatgcaatcgcagaggccctgaggcgcccctgctttacccctgtgctgggccggagatcttgtccaatcgccagaccactgctggacggagaggcagtggaggccagcgatgccaaggccgccctggcaaccatcgcaccagtgggcggcatgatctatacagagggagagctgatctccgcccagccactgagggtgcgcgacgtgcctatccagggccggcacagacagttctctacccgcctggtgtacctgcacaagggcgagacatgcagctaa

SEQ ID NO: 111 - DNA, 627 bp, Methylocaldum sp. 14B
  misc_feature (1)..(627): Cas6
atgtttctgtcccgcgtggagatcccatgggacgccgtgcggaacccctacgagatccacaggcagctgtggaggctgttcccaggagaggataaggagcctcgcaagaatgccgaggagggcaggcagggcttcctgtttcgcgtggagaacaatcagcccggccggcctctgagactgctgatccagagcaggagggcccctgagccaacagcaggactgaccatcgtgggcacaagagagtttcagccacagcctgcacacggacagaggctggccttcctgctgacatctaaccctgtgaagaccatcatcgacgcccagcgcgagaccaagagcggcaagtcctctgagaagtgccgggtgccactgatccacgagtccgagcagagggagtggctgaagaggaagctgatcggagcaggagagttcgagggagtgaacgtggtgccacacgcacccgtgttctttcggaagggcaatagaggcggcaagatcgtgatggtgacctttgagggcgtgctgagggtgaacgagccaggcacactgatcgcctatctggagaatggcatcggaccagcaaaggccttcggctgcggactgctgctggtgcggagactgggataa

SEQ ID NO: 112 - protein, 502 aa, Methylocaldum sp. 14B
  misc_feature (1)..(502): Cas8
MNLLEDPWIPVRADGGTGAFQLLTYRQLLCEPGNWQVSLPRDDLELACVQLLVCMTQVMFLPENDAVWRKRLTEALTREEFTAGTEPCLDWFDLDHPTQPFMQSRGVRAAEDTPIQKLLIGLPEGNNHAFFNEAGEVRHLSVTVAAIALFNQATNCPSFGGGFKGSLRGGAPITTLVNGENLRETVWCNVLTRSRLAARQIAMPGLDRDRPTWVEPIQEKATIPWNTIGLARGLFWQPARVELVRSMAAAPCDVMGGAPTLGYVGFRKEKFNFTVEGVWPHPHGAITMTLKKGALEQKFASFTTTAPAWTQLSEFVVPKGVNDPGAKEGSIPAGPVTQASELGESGLHLLVGGYRTNQASVLERRHEMMSLARGWRDDKSRLPKLVEMGKEAKKALRGKLYFAVQGNKDKGLKGIGAAIHETAEKLFYARTESLIHETFSNELTFKQWATARKAFVQELAGHCRAIFEELTAPYAMKPELIPVIAWARRSLNFDLTKLMEDA

SEQ ID NO: 113 - protein, 151 aa, Methylocaldum sp. 14B
  misc_feature (1)..(151): Cse2
MTAELPDFVALKMHYDDESFPTGARAELRRAAEPDDVALTPALYRLFPGERPSDRHLRVAYLLPYAKHAAKAKSLGAQLAEAKVAEARVLQVARAHEPLDVVQLRRLLMQVEAAVDWSAFGPMVWFWNERAKRQLIEDFYIARFSPVTGAK

SEQ ID NO: 114 - protein, 378 aa, Methylocaldum sp. 14B
  misc_feature (1)..(378): Cas7
MTKKNFINFHVLISHSPSCLNRDDMNMQKTAVFGGVNRVRISSQSLKRAIRKSDYYQANLGAPSVRTRDLNKLKARFTELLKDRFDAELINRALEWISGKEGIAEGVTADAVAPWSVDEVTHFCEIISADDQQDIKKLEKQIEKEARPFRAAMSNTVDIALSGRMATSGLMSNLPVDGALAVAHAITTHAVEPQDVDWFTAVDDLTQDAGDTGAGHLDTQQFSSGVFYRYASLNLRQLQVNLGLIDHIKAEETAESRQRALDIAHHVFHLLATVVPSAKQQSFAAHNLADFAIVSFADQPISLANAFEEPVRRDYKLAGFLKPSIQCLANYWGRMNRAYGLDEQARAFAVDASFEMGGKPPLDSLKAVEDWIAEDGQE

SEQ ID NO: 115 - protein, 226 aa, Methylocaldum sp. 14B
  misc_feature (1)..(226): Cas5
MPRYLILLLDGPMQAWGTHTFEDFRPCNAFPTRSGLLGLLGACLGLDRRDTEALEQLAMSVEFAVRADREVLRPEAEVPKAKAAVKLPDFHTVEDARKVDGSANKNPVVSRREYLFDAAFTVAIGAKPDGPVTLDAIAEALRRPCFTPVLGRRSCPIARPLLDGEAVEASDAKAALATIAPVGGMIYTEGELISAQPLRVRDVPIQGRHRQFSTRLVYLHKGETCS

SEQ ID NO: 116 - protein, 208 aa, Methylocaldum sp. 14B
  misc_feature (1)..(208): Cas6
MFLSRVEIPWDAVRNPYEIHRQLWRLFPGEDKEPRKNAEEGRQGFLFRVENNQPGRPLRLLIQSRRAPEPTAGLTIVGTREFQPQPAHGQRLAFLLTSNPVKTIIDAQRETKSGKSSEKCRVPLIHESEQREWLKRKLIGAGEFEGVNVVPHAPVFFRKGNRGGKIVMVTFEGVLRVNEPGTLIAYLENGIGPAKAFGCGLLLVRRLG

SEQ ID NO: 117 - DNA, 90 bp, Methylocaldum sp. 14B
  misc_feature (1)..(90): CRISPR
ctgttccccacgtacgtggggatgaaccgacggcgtaatggtaattgttagccgacaagttctgttccccacgtacgtggggatgaaccg

SEQ ID NO: 118 - DNA, 1632 bp, Methanocella arvoryzae MRE50
  misc_feature (1)..(1632): Cas8
ttgaaaaatcgagtgaaaagaggtgaacatttggtctcatataacttgttaacagaaccgtggatcacatccatcgacctgtccggaaacccggtgcaggagggaatactggcgactttgaaaaacgcacataagatcgacagtatttttgatccggctcctccggtagaattcggaatataccgcctgctgatcgcttttataacagatgtcttccagcctcagggactggaggatctggccgatctcctcgaccgtaagcggttagaccccacagcgctggacgaatatgccgccaggtggagagaccggtttgatctgttcgacgaaaaatacccgttcttacagcaggcaataacgggggtaataaagaaacctcccgagccgatctccaggttgatgcagcatctgccggcaggcactaacgtctcccattttcaccatggacgctgggatgagaactccttctctttcgagcagtgcgccaaagggctggtgactatagccccgttcatgacagccggcggcgctggcctgtccccaagcattaacggcagcccaccttggtacgttcttgtaaaaggcaacaacctgttcgagactctcctctacaacgtctgccagataccaatgactgtcaaacctatcggagattcacctgtagcctggaggaacgacaaacgaatcgatcccggcgatgaacctaaaaccttttccatcgtcgaaggtctgacctggaggcccaggatcattcagcttatcccgggaaacggcaagggcacatgcacgtatactggagaaaaagacgttgacacggtcagccacatgcattattacccgggacaaaaatcgcccgagccaggcctgtgggtcgatcctcaggtagcatataaaaagactaaggatgccatcaggccgctcaggccggacgagaacaaggcgctgtggcgagacattgggccgttgatgctcctgcaacacggggactactcgggcaaagacggaaaagtaagcttcgatcggccggcggtagttactcagtacaaacagatggtcagcaatggtatgatcaaacgcagcgagcctttaagactggaagtttatggtatccgcacagatggaaaaatgaagatttacgaatggtaccatgaaaaactagctcttcccatagaaatcttgaaaaaggcaaactccggccgacaaatacaggacgcgatggacctcgcagatagcgtagcttacatactccggaaagccatgaaaaaagcctacccgagaaatgcaaaatctaacgagagtggattcgacaatctcattctgagcgttcagtcttcctactggagccatctgaaaggccagttcgaaagcattttcttaaaaacgctgtctcaacaggacgaaaatgatctcgacgcatacactaagctcatggaacagtggaagaaaatactggacgatactggaaagaacgcgctcgataaaggcctcggaccgctggatactgacggcgattcgctacgccgccaggtcaaggcgatgaacgagtacagttcaggcatcagatttgcgctgtaccctgattccatacaggcgaagaaaaagaatcgacagaaaaataaggaggataaatga

SEQ ID NO: 119 - DNA, 591 bp, Methanocella arvoryzae MRE50
  misc_feature (1)..(591): Cse2
atgaccgctcccaacgaaaacaaagagcaccagaagagtaaaaaggatgaggagttcctggcgaacttagcaaagatggccgaatccgatcgtggcggtatggccatcctgaagcgaaacgccggcaacacgatagcagagtctcgcggcgcgatgaaaactttctatagcctgctaccttacggcatttcagattccccctacgaggagatctacttcctgatagccactctgtacgggcataataagtaccgatttacaggggacttcggacagacgatgaagcttgtaagagagagctcaaactcggaaagcatcgaccagagagtgtcaactctgctcgacagcgagttcaacatcgtcgacgggataaaacccggcgggggagaactcgcctatcggctgcggcaatgcgtgaaactggccagcggccacgagatcggggtagactggtacaggctcctgcaggacctgaaatactggggctacccggaaaagagagtacagaagagatgggccagatcatatttcggctacggaaagccggtagaatctgaaactaaagagtcaaaagaggaggcaaaagcatga

SEQ ID NO: 120 - DNA, 1176 bp, Methanocella arvoryzae MRE50
  misc_feature (1)..(1176): Cas7
atgaaattaatcgagatacacatgatccagaaccacgctccctgcaatctgaacagggatgacacaggaagcccgaaagactgcatgttcggcggcatcaggcgatcgaggatatccagccagagcatcaagcgcagcatcaggatgtccccgatattcaaggaagagatgaagggaatcgaactggcgaacaggacacgcaggcttcctgaactcgtcaaggccaagctcatcagtgatggaatagacgaaaagatggcggccatagcggcagaaaaggccaccggtttcggaaccaaggacggtaaagaacgcgaggaagacctgaacacggcccagacaatgttcataacccagtctgacgtcgacgctgtagcatcggtcatgaaggatgccatcctgaaagccggaaaccctaaggcattcaaggacatgaaagccgccgatcttcaaaaagccgcagaactcaagggatggcggcctgtaacaccggacctggcccttttcggccggatgatcacatcggatgcattcatggacatcgaggcatccatgcaggtggcccatgcgatctccacgaacaaaatggaccacgagtttgattacttcactgccgtggatgaccttcagaagtcttccgacggccccggagcagatatgatcggcgacgtccagttcaactctgcctgctactacaagtacttctcactggattacgatgccctgatacagaatctcgcaggcttgaaacccggagataatgccacggaagccgataaaaaagcctatgctgaatcgctggaaaacgcgaaaaaagtcgccgcgatcactatcaccgcctttctaaaagcggccatctacacgacgcccagtggaaagcagaacagcttcgccgcgcatcagctccccagcgccgtccttgtggaaattcggccaacaaagacgccagtaagctacgctaacgcgttcgttgatccggcccgcccgagaaacggtgtcgacatggtggaagataccctgaacaaattcgtgaaacatgtcgagctccagactgagaagttcaacctgagatcgaccaggcggctctggttcgttgcgggcgataaggcgctcgccggaacggaaacctgccagacgatcaacgatctaatatccggtataaacagtgccctctaa

SEQ ID NO: 121 - DNA, 684 bp, Methanocella arvoryzae MRE50
  misc_feature (1)..(684): Cas5
atggacaacccattgctcctgctgttgaggctggaggggccaatgcagtcatgggggctgaaagccaggtgggatatcagagataccggggacgagcctaccaagtccggcatcatcggactgctcggctgcgctctcggatatgcccgaaaggacccgcggctgactgacgaactggactcacaacttcggataggcattcgtgtggagtgccccggcgaaatcgccagggattaccacacggtcagcggagagcttcggaccgccgaaggtaagctccgcgaaacgacgattgtatccttcagagactatctccaggatgcagcgttcctcgtagtactcgaaggcccgggagaactgcttaccagaataagcaacgctctgaaagaccctgtatggccaatctatctgggaagaaaatcctgcccaccgacccgccccgtcttcgaaaccctgaccactgactatgcttcgatagacgatgcactgagccgacacccgtggagttccgggactatggaagcccgcaaagcgcaccccaaagaattaaaatgtatagtcgaagacctctccggaccttaccagaggactgatcggatgacgaaaagcccggccagaatgtacggcatcaggcacgtccggatgagcactgtaaaacttcaagcagaaggagagggcctttaa

SEQ ID NO: 122 - DNA, 753 bp, Methanocella arvoryzae MRE50
  misc_feature (1)..(753): Cas6
atgtatttatcaagactgatcctgaacccgagaacaagggctgtcagaagagacctcgctgactgccacgaacttcatcggactattctggggggctttccggaccttaatggaaaaggaggcgaagcaagggaaaccttcggcgttctccaccggatcgacatccaccccagaagcggcgcgatcgtactactggtccagtcgcaggaaaagcccgactggtcaaagctgccagaaggctatctactcgaaaatacgggcacggaaaatccagcctgtaaggctatagacgaacagtacgggaaaataaaggccggcgatgtctatgctttccgtcttcgagccaatcctacgaaaaagatcggcacgtcccggattgaggacatcaaagccggcaagcctaaaaataacgggcggcgggtgccgatcagaaacgagagcgaccagatcctctggctgaaaagaaaaggcgcggcaggaggcttcgaactcatgtccacgaagaggtttagcgaactctccgatgtgctcatcagtgaagaaggccatcagaaaatatacaccttcgacactggaataaaagcaaaagtccagaaaaacgcccgggaaaatagattaaccttcggctcggtccttttcgaaggcaccctgaaagtgacaaatgcagaaaagttcctcgaaaccctcaaatccggcatcggcagcggcaaagcctatggcttcggcctcctatccttagctccggcaaggtga

SEQ ID NO: 123 - DNA, 1632 bp, Methanocella arvoryzae MRE50
  misc_feature (1)..(1632): Cas8
atgaagaatcgcgtgaagcggggcgagcacctggtgtcttataacctgctgacagagccttggatcacctctatcgatctgagcggcaatccagtgcaggagggcatcctggccaccctgaagaacgcccacaagatcgatagcatctttgaccctgcccctccagtggagttcggcatctacaggctgctgatcgcctttatcaccgacgtgttccagccacagggcctggaggacctggcagatctgctggacaggaagcggctggaccccacagccctggacgagtacgcagcacggtggagagataggtttgacctgttcgatgagaagtatccattcctgcagcaggccatcaccggcgtgatcaagaagccccctgagcccatctctcgcctgatgcagcacctgcctgccggcacaaatgtgagccactttcaccacggccggtgggacgagaactcttttagcttcgagcagtgcgccaagggcctggtgacaatcgcacccttcatgaccgcaggaggagcaggcctgtccccttctatcaacggcagcccaccctggtacgtgctggtgaagggcaacaatctgtttgagacactgctgtataacgtgtgccagatccccatgaccgtgaagcctatcggcgatagcccagtggcctggagaaacgacaagaggatcgaccctggcgatgagccaaagacattctccatcgtggagggactgacctggaggcctcggatcatccagctgatcccaggcaatggcaagggcacctgtacatataccggcgagaaggacgtggataccgtgtcccacatgcactactatccaggccagaagtctcctgagccaggactgtgggtggacccccaggtggcatacaagaagacaaaggatgccatcagacccctgaggcctgacgagaataaggccctgtggcgcgatatcggaccactgatgctgctgcagcacggcgattactctggcaaggacggcaaggtgagcttcgatcggccagccgtggtgacccagtataagcagatggtgtccaacggcatgatcaagcggagcgagccactgcggctggaggtgtacggcatccgcacagacggcaagatgaagatctacgagtggtatcacgagaagctggccctgcccatcgagatcctgaagaaggccaattccggccggcagatccaggacgccatggatctggccgactctgtggcctacatcctgagaaaggccatgaagaaggcctatcctaggaacgccaagtccaatgagtctggctttgacaacctgatcctgagcgtgcagtctagctattggtcccacctgaagggccagtttgagtctatcttcctgaagacactgagccagcaggatgagaatgacctggatgcctacaccaagctgatggagcagtggaagaagatcctggacgatacaggcaagaacgccctggacaagggactgggacccctggacaccgatggcgactccctgcggagacaggtgaaggccatgaacgagtactcctctggcatcagattcgccctgtatcctgactctatccaggccaagaagaagaacaggcagaagaataaggaggataagtaa

SEQ ID NO: 124 - DNA, 591 bp, Methanocella arvoryzae MRE50
  misc_feature (1)..(591): Cse2
atgacagccccaaacgagaataaggagcaccagaagagcaagaaggacgaggagttcctggccaacctggcaaagatggcagagagcgataggggaggaatggccatcctgaagcggaacgccggcaatacaatcgccgagagccggggcgccatgaagaccttttacagcctgctgccatatggcatcagcgactccccctacgaggagatctatttcctgatcgccaccctgtacggccacaacaagtataggtttacaggcgacttcggccagaccatgaagctggtgcgcgagtcctctaattctgagagcatcgatcagcgggtgagcacactgctggattccgagtttaacatcgtggacggcatcaagccaggaggaggagagctggcatacaggctgaggcagtgcgtgaagctggcaagcggccacgagatcggagtggattggtatagactgctgcaggacctgaagtactggggctatccagagaagagggtgcagaagcggtgggcccggtcctacttcggctatggcaagcccgtggagtctgagaccaaggagagcaaggaggaggcaaaggcataa

SEQ ID NO: 125 - DNA, 1176 bp, Methanocella arvoryzae MRE50
  misc_feature (1)..(1176): Cas7
atgaagctgatcgagatccacatgatccagaaccacgccccctgcaacctgaatagagacgataccggcagccctaaggactgtatgtttggaggcatccggcggagccggatcagctcccagagcatcaagagatccatcaggatgtctcctatcttcaaggaggagatgaagggcatcgagctggccaatcgcacaaggcgcctgccagagctggtgaaggccaagctgatctccgatggcatcgacgagaagatggcagcaatcgcagcagagaaggcaacaggctttggcaccaaggatggcaaggagcgggaggaggacctgaatacagcccagaccatgttcatcacccagtccgacgtggatgccgtggcctctgtgatgaaggatgccatcctgaaggccggcaaccccaaggccttcaaggatatgaaggcagcagacctgcagaaggcagcagagctgaagggatggagaccagtgacacctgacctggccctgtttggcaggatgatcaccagcgatgccttcatggacatcgaggcctccatgcaggtggcccacgccatctctacaaataagatggatcacgagtttgactacttcaccgccgtggacgatctgcagaagtctagcgacggacctggagcagatatgatcggcgacgtgcagtttaacagcgcctgctactataagtacttctccctggactatgatgccctgatccagaacctggccggcctgaagccaggcgataatgccaccgaggccgacaagaaggcctatgccgagtccctggagaatgccaagaaggtggccgccatcaccatcacagcctttctgaaggccgccatctacaccacaccatccggcaagcagaactctttcgccgcacaccagctgccaagcgccgtgctggtggagatcaggccaaccaagacacccgtgtcctacgcaaacgccttcgtggaccccgcaaggccccgcaatggcgtggatatggtggaggacaccctgaacaagttcgtgaagcacgtggagctgcagacagagaagtttaacctgcggagcacccggagactgtggttcgtggcaggcgacaaggccctggcaggaaccgagacatgccagacaatcaacgatctgatcagcggcatcaattccgccctgtaa

SEQ ID NO: 126 - DNA, 684 bp, Methanocella arvoryzae MRE50
  misc_feature (1)..(684): Cas5
atggataacccactgctgctgctgctgcggctggagggaccaatgcagagctggggcctgaaggcaagatgggatatcagggacacaggcgatgagcccaccaagagcggcatcatcggactgctgggatgcgcactgggatacgccagaaaggaccccaggctgaccgacgagctggattcccagctgcgcatcggcatccgggtggagtgtcctggcgagatcgccagggactatcacacagtgagcggcgagctgcgcaccgcagagggcaagctgcgggagaccacaatcgtgtcctttagagattacctgcaggacgcagccttcctggtggtgctggagggaccaggagagctgctgaccaggatctccaacgccctgaaggaccccgtgtggccaatctacctgggcagaaagtcttgccctccaacaaggcccgtgttcgagaccctgaccacagactatgcctccatcgacgatgccctgagccggcacccttggagctccggcaccatggaggcaaggaaggcacacccaaaggagctgaagtgtatcgtggaggacctgtctggcccataccagagaacagataggatgaccaagagccccgccagaatgtatggcatccgccacgtgcggatgagcaccgtgaagctgcaggcagagggagagggactgtaa

SEQ ID NO: 127 - DNA, 753 bp, Methanocella arvoryzae MRE50
  misc_feature (1)..(753): Cas6
atgtacctgtctcggctgatcctgaaccctaggacccgcgccgtgaggcgcgacctggcagattgtcacgagctgcaccgcacaatcctgggcggctttccagacctgaacggcaagggaggagaggcaagggagaccttcggcgtgctgcacagaatcgatatccacccaaggagcggcgcaatcgtgctgctggtgcagagccaggagaagcccgactggtccaagctgcctgagggctacctgctggagaacaccggcacagagaatcctgcctgcaaggccatcgacgagcagtacggcaagatcaaggcaggcgacgtgtacgccttccggctgagagccaatccaacaaagaagatcggcaccagccggatcgaggatatcaaggccggcaagcccaagaacaatggccggagagtgcctatccgcaacgagagcgaccagatcctgtggctgaagaggaagggagcagcaggaggatttgagctgatgagcaccaagaggttcagcgagctgtccgacgtgctgatctccgaggagggccaccagaagatctatacattcgataccggcatcaaggccaaggtgcagaagaacgccagagagaataggctgacctttggcagcgtgctgttcgagggcacactgaaggtgaccaatgccgagaagtttctggagacactgaagagcggcatcggctccggcaaggcctacggattcggactgctgtccctggcacctgcaaggtaa

SEQ ID NO: 128 - protein, 543 aa, Methanocella arvoryzae MRE50
  misc_feature (1)..(543): Cas8
MKNRVKRGEHLVSYNLLTEPWITSIDLSGNPVQEGILATLKNAHKIDSIFDPAPPVEFGIYRLLIAFITDVFQPQGLEDLADLLDRKRLDPTALDEYAARWRDRFDLFDEKYPFLQQAITGVIKKPPEPISRLMQHLPAGTNVSHFHHGRWDENSFSFEQCAKGLVTIAPFMTAGGAGLSPSINGSPPWYVLVKGNNLFETLLYNVCQIPMTVKPIGDSPVAWRNDKRIDPGDEPKTFSIVEGLTWRPRIIQLIPGNGKGTCTYTGEKDVDTVSHMHYYPGQKSPEPGLWVDPQVAYKKTKDAIRPLRPDENKALWRDIGPLMLLQHGDYSGKDGKVSFDRPAVVTQYKQMVSNGMIKRSEPLRLEVYGIRTDGKMKIYEWYHEKLALPIEILKKANSGRQIQDAMDLADSVAYILRKAMKKAYPRNAKSNESGFDNLILSVQSSYWSHLKGQFESIFLKTLSQQDENDLDAYTKLMEQWKKILDDTGKNALDKGLGPLDTDGDSLRRQVKAMNEYSSGIRFALYPDSIQAKKKNRQKNKEDK

SEQ ID NO: 129 - protein, 196 aa, Methanocella arvoryzae MRE50
  misc_feature (1)..(196): Cse2
MTAPNENKEHQKSKKDEEFLANLAKMAESDRGGMAILKRNAGNTIAESRGAMKTFYSLLPYGISDSPYEEIYFLIATLYGHNKYRFTGDFGQTMKLVRESSNSESIDQRVSTLLDSEFNIVDGIKPGGGELAYRLRQCVKLASGHEIGVDWYRLLQDLKYWGYPEKRVQKRWARSYFGYGKPVESETKESKEEAKA

SEQ ID NO: 130 - protein, 391 aa, Methanocella arvoryzae MRE50
  misc_feature (1)..(391): Cas7
MKLIEIHMIQNHAPCNLNRDDTGSPKDCMFGGIRRSRISSQSIKRSIRMSPIFKEEMKGIELANRTRRLPELVKAKLISDGIDEKMAAIAAEKATGFGTKDGKEREEDLNTAQTMFITQSDVDAVASVMKDAILKAGNPKAFKDMKAADLQKAAELKGWRPVTPDLALFGRMITSDAFMDIEASMQVAHAISTNKMDHEFDYFTAVDDLQKSSDGPGADMIGDVQFNSACYYKYFSLDYDALIQNLAGLKPGDNATEADKKAYAESLENAKKVAAITITAFLKAAIYTTPSGKQNSFAAHQLPSAVLVEIRPTKTPVSYANAFVDPARPRNGVDMVEDTLNKFVKHVELQTEKFNLRSTRRLWFVAGDKALAGTETCQTINDLISGINSAL

SEQ ID NO: 131 - protein, 227 aa, Methanocella arvoryzae MRE50
  misc_feature (1)..(227): Cas5
MDNPLLLLLRLEGPMQSWGLKARWDIRDTGDEPTKSGIIGLLGCALGYARKDPRLTDELDSQLRIGIRVECPGEIARDYHTVSGELRTAEGKLRETTIVSFRDYLQDAAFLVVLEGPGELLTRISNALKDPVWPIYLGRKSCPPTRPVFETLTTDYASIDDALSRHPWSSGTMEARKAHPKELKCIVEDLSGPYQRTDRMTKSPARMYGIRHVRMSTVKLQAEGEGL

SEQ ID NO: 132 - protein, 250 aa, Methanocella arvoryzae MRE50
  misc_feature (1)..(250): Cas6
MYLSRLILNPRTRAVRRDLADCHELHRTILGGFPDLNGKGGEARETFGVLHRIDIHPRSGAIVLLVQSQEKPDWSKLPEGYLLENTGTENPACKAIDEQYGKIKAGDVYAFRLRANPTKKIGTSRIEDIKAGKPKNNGRRVPIRNESDQILWLKRKGAAGGFELMSTKRFSELSDVLISEEGHQKIYTFDTGIKAKVQKNARENRLTFGSVLFEGTLKVTNAEKFLETLKSGIGSGKAYGFGLLSLAPAR

SEQ ID NO: 133 - DNA, 90 bp, Methanocella arvoryzae MRE50
  misc_feature (1)..(90): CRISPR
aaagtccccacaggcgtgggggtgaaccgtgatcagtaacccggtcaccattaaacagattaaagtccccacaggcgtgggggtgaaccg

SEQ ID NO: 134 - DNA, 1701 bp, Lachnospiraceae bacterium KH1T2
  misc_feature (1)..(1701): Cas8
atgtgtgaccaacagtatgttagtacactgaatgtattaaaagatccgtggattccagttgtatttttggatggaaagataaaagatgttggaatcattgaatgctttagaaatgcagaaaagattaaaacaatatcgaattctaagccatatgaaaagattgcgatactacggtttttgacagcgttcattacggatgtatatcaactggatagacgtattgaacggcaaaagttatatgatgcgggatcatttgaaattgaacgtattgagaattatgttaaagaatgtgaagagaagaatggagcttcatttgttttgggtgattctcaaagatcttttttttgctttaactataatccgcaagttgatacagagggagtgaaattatctgcagcgtatttgcatttggaactgcctcatggcaataatcctattcacatagttgcccagagagaggaagattttgaaggtgatacgctgcctcaatttttgagggctgcattagcgtttaatttattcccgactggaaacatgttaaagggagcgaatagtaaaacgggtgataactgctatatagacggtgtggggaaagatggcaaacctaaatatacagctgcgtatggctcgatgggaataaatgcaggaagttcaatggcagcggctgaaccggttttcttttggccagaatgtgacaatttgtttcatacacttgttatgtgtatgcgcagtcaaggagaactacagaataatttaaaattaaatgatccaccagctttttggaatgccgatgcagaacctaatcctaaagcaggaaaacgtggtgatatagtaacttcagtctcttttgtgtcaggtcttgcttttcaggcaagaagaattgtaccggtcattgaaaacggaaaagtttatgaatgctatataagtaatggttataccaattcgaatgaaaacgtgtggcatgatccttttgctgttagattgagaaatcataagtcgggagaaatttttcagatgccggctaaaggggatcgagaaatgtggagaaatattggaaatttgactgcatctagagaagaaagctggcatttaatgccggatgtccttagaccaattaaaaaaagtgcagatgctacagattattatgagaatatttcttctcttgcaatgatacctatgacccagaatgcaggatacagtgctatgttctatgatgatacagtacaaattccgaaagaatatttggaagactcatatttgggtgaatatttaactacaagaatggaaatagtagaagaaatttctaagatgtgggacaagcttaaaatatcggcgcttctggataataaggataaattttcaggacattatagagatgatgcactgcaagagtattgggtcaagattcatcaatttttatttgatggcgatgatagcttcttaaatcatgtgataagaatgtatcatgaagattcttcttcttttgaaaaaacggcagataaagcattatttgaatatttaacgaagagtgttaaagaaatatgcgaaaaagaagagaagaacacgaattcatggaatatgttggtgaaaataatcaggcaaatacatggtaagaatggctgtcttcatattttttacggaacgttaaagaaatattggaagaaggagggaaaggataagaatgatacaggaagcatatga

SEQ ID NO: 135 - DNA, 498 bp, Lachnospiraceae bacterium KH1T2
  misc_feature (1)..(498): Cse2
atgatacaggaagcatatgaaaaacttgcacatgaggaaaaaaggttgtttgctcattgtgcaggtaaattaataaaagacgctccaaaagctattataccgttttataaggtggtgccaagtgaaattgaaagtaaaaacgggaaaaagtatacagttgatgaagatgctttttttgctgctttgtgtgtaagatgcctattcgaaaaaattgagggcgttacattagaacctgacatattaattagtgaaggaagaaaaaatcctaaaatatctttggaaggttatgatagaagaatttcagcattaatgtcaaatactgaagctgaattttttattccaaaacttgcaaagttaatgaattatacgctaaaaattacttctaataaaataccggattgtgatcagttatattgggatattcataatattggaagcaatgaaaaagatgttcagcgacgttgggcacgtacaatatatgtaaataatgaagagtga

SEQ ID NO: 136 - DNA, 1188 bp, Lachnospiraceae bacterium KH1T2
  misc_feature (1)..(1188): Cas7
atgagtaattcaaagtatcagttcttaaatggaaagaaacttgcagagtttcatatgttgaagctatatccgtcatcagcattaaaccgcgatgatgcaggtgagcagaaaacgggaatgtacaatggcacgcttaggaatagaatttcaagtcagtgtattaaacgttcatggaggctttctgaaactttcgaagatgtttttgatgaaattggaatacgtactaagagaatgccagaatatgttggaaaaaaattggttgagaatggagtgccggaagaggatgtaatcagttttaagaaaatcctttctggtgaaaaggttgatgaaaaatcatctaagaaaagtaaagctgatcaggctatagacgaaggtaagccagtaaagactgctgcattgtcattttattcagtggaggaacttgataaaattgctgagatatgtaaaagaatttatgatgatttggaagagcctaaatccaaaaatctgaagacaataaaaattgacaatattcagaaggaaatgcgtaagtgcgttcatccgatgaatattgatgttgcagcatttgggcgtatggtaactgacaacatgcttcgtccggtagaaggcgcaatgcaggtggcacaggcattatcaactaatgctgcggtcaaggaaaatgactattttgtggcttgcgatgatctggtaaaaggagaaaccattgaagatgtcggtggtgaaatgcttggagatattgactataattctgcatgctattatattcatgcaaatgcagatttagagcagtttgcagaaaatttgaaggattgtgaaaacatggaagaaatagtgaaagcattgccttcaaatatggtggaagtaatggcatatacagatccaacagcgagacagagtacaatggaggcgcatgttcttccagaggttatttatgtggaactaaagagtaaaaagcgtcctttgaacagaatgaaggcatttgcggaaccgtgtaatagaaatattgctgaaaagagtgctaaaaaacttgctgattatataaattgcacaaacgaaaaagctgatttaggaataacaaatgcactgtggtattgtgaggatgaaagtgttaaagcgcctgaaaatgttactgtagtgaacagtataaaagaacttgagcaaaagcttaatgagtggatgaatgaatga

SEQ ID NO: 137 - DNA, 483 bp, Lachnospiraceae bacterium KH1T2
  misc_feature (1)..(483): Cas5
atgaaaataaaaattgttttagaaggtgcatttcaagcctggggagtaccatctgaatatacttggagaggaacatcgtattatccgacagctagaggaattgtaggtttgattggatgttgtatgggtataccaaggggagatgataggcttgagcagctattatcggtgttaaaaataacatatgatataaacgaagatgataatgggaacagaaaatcaggatcaatacttacagattttcaggttgtgagaaaggaagatggcggcaagttaaatgcagcgaatggaggaactggcgattcatatggaatcatattgcataaatcctacataaatgatgcatcatttacggttcatatagagggtcctgatgatctgatgaaagatgtatatgatgcaatgcttgatccagtttgggttccatatctaggaagaaaaaattgtccgcctacagaaccacttattcctgaaattgaatag

SEQ ID NO: 138 - DNA, 618 bp, Lachnospiraceae bacterium KH1T2
  misc_feature (1)..(618): Cas6
atgtatttaacaaaattagaattaaatatacaaaacaaagctgttcttcataatatgtcaaattgtgaatggatgcataagctgattcttgaaaaaggatttggacatattcaagccgaaaatgcaagacagacgttaaagatattatatgctgtagatggcataaaagtttatgttcaaagtgctgtagaacccaaatttgaaaattgttcatattggataagtactccggctaccatttgtattgatgcgatgaaaaaaatttgtgggacaggtatggctgtacattttaaatgtacgtgtaatccaacgaaaaagttgatcgatggcggaaagcgtatttttctatcatctgagagagagagagatgagtggattaagcgtgtgatggagcgttccggagcagaagttttggttgagagtcagacttctgactttacggtatggggaatgaagaaagataaaaaaacagataaatctcacaaaatttatgctaaagcggtcacatattcaggtgcactaaaaataacagatgaagaaaaattttgggaagcattttgtaatggcataggtcgagaaaaagcttatggttgtggaatgttaatgatacaggtttga

SEQ ID NO: 139 - DNA, 1701 bp, Lachnospiraceae bacterium KH1T2
  misc_feature (1)..(1701): Cas8
atgtgcgatcagcagtacgtgtctacactgaatgtgctgaaggacccttggattcccgtggtgtttctggacggcaagatcaaggatgtgggcatcatcgagtgtttcagaaacgccgagaagatcaagaccatctctaacagcaagccatatgagaagatcgccatcctgagatttctgaccgccttcatcacagacgtgtaccagctggataggcgcatcgagaggcagaagctgtatgacgccggctctttcgagatcgagcgcatcgagaattacgtgaaggagtgcgaggagaagaacggcgccagctttgtgctgggcgatagccagcggtccttcttttgtttcaactacaatccccaggtggacaccgagggagtgaagctgagcgccgcctatctgcacctggagctgcctcacggcaacaatccaatccacatcgtggcccagagggaggaggactttgagggcgatacactgccacagttcctgagggccgccctggcctttaatctgttccctaccggcaacatgctgaagggcgccaattctaagacaggcgacaactgctacatcgatggcgtgggcaaggacggcaagcctaagtacaccgccgcctatggcagcatgggcatcaatgcaggctctagcatggcagcagcagagcccgtgttcttttggcctgagtgcgataacctgtttcacacactggtcatgtgcatgaggtcccagggcgagctgcagaacaatctgaagctgaacgatcctccagccttctggaatgcagacgcagagccaaaccctaaggcaggcaagaggggcgacatcgtgaccagcgtgagcttcgtgagcggcctggcattccaggcaaggagaatcgtgccagtgatcgagaatggcaaggtgtacgagtgttatatctctaacggctacacaaacagcaatgagaacgtgtggcacgatccatttgccgtgaggctgcgcaaccacaagtccggcgagatcttccagatgccagcaaagggcgacagggagatgtggcgcaatatcggcaacctgaccgcctccagggaggagtcttggcacctgatgccagatgtgctgcgccccatcaagaagagcgccgacgccacagattactatgagaatatctcctctctggccatgatcccaatgacccagaacgccggctacagcgccatgttctatgacgatacagtgcagatccccaaggagtacctggaggattcctacctgggcgagtatctgaccacaaggatggagatcgtggaggagatctctaagatgtgggacaagctgaagatcagcgccctgctggacaataaggataagttttccggccactacagggacgatgccctgcaggagtattgggtgaagatccaccagtttctgttcgacggcgacgattctttcctgaaccacgtgatcagaatgtaccacgaggatagctcctcttttgagaagaccgccgacaaggccctgttcgagtatctgacaaagagcgtgaaggagatctgcgagaaggaggagaagaataccaactcctggaatatgctggtgaagatcatccgccagatccacggcaagaacggctgtctgcacatcttctacggcaccctgaagaagtattggaagaaggagggcaaggacaagaacgatacaggcagcatctaa

SEQ ID NO: 140 - DNA, 498 bp, Lachnospiraceae bacterium KH1T2
  misc_feature (1)..(498): Cse2
atgatccaggaggcctacgagaagctggcccacgaggagaagcggctgtttgcccactgtgccggcaagctgatcaaggacgccccaaaggccatcatccccttctacaaggtggtgccctccgagatcgagtctaaaaacggcaagaagtataccgtggacgaggatgccttctttgccgccctgtgcgtgaggtgtctgtttgagaagatcgagggcgtgacactggagcccgatatcctgatcagcgagggccgcaagaatcctaagatctccctggagggctatgaccggagaatcagcgccctgatgtccaacaccgaggccgagttctttatccctaagctggccaagctgatgaattacaccctgaagatcacatccaacaagatcccagactgcgatcagctgtattgggatatccacaatatcggctctaacgagaaggacgtgcagaggcgctgggcaaggaccatctacgtgaacaatgaggagtaa

SEQ ID NO: 141 - DNA, 1188 bp, Lachnospiraceae bacterium KH1T2
  misc_feature (1)..(1188): Cas7
atgagcaattccaagtaccagtttctgaacggcaagaagctggccgagttccacatgctgaagctgtatcctagctccgccctgaacagagacgatgccggcgagcagaagaccggcatgtataatggcacactgaggaacagaatctctagccagtgcatcaagcggtcttggagactgagcgagacctttgaggacgtgttcgatgagatcggcatcaggacaaagcgcatgccagagtacgtgggcaagaagctggtggagaatggcgtgcccgaggaggatgtgatctcttttaagaagatcctgagcggcgagaaggtggacgagaagtcctctaagaagtccaaggccgaccaggccatcgatgagggcaagcctgtgaagaccgccgccctgagcttctactccgtggaggagctggataagatcgccgagatctgcaagaggatctatgacgatctggaggagccaaagtccaagaatctgaagacaatcaagatcgacaacatccagaaggagatgcgcaagtgcgtgcaccccatgaatatcgatgtggccgcctttggcaggatggtgaccgacaacatgctgaggcctgtggagggagcaatgcaggtggcccaggccctgtctacaaatgccgccgtgaaggagaacgattatttcgtggcctgcgacgatctggtgaagggagagaccatcgaggacgtgggaggagagatgctgggcgacatcgattacaatagcgcctgctactatatccacgccaacgccgatctggagcagtttgccgagaatctgaaggactgtgagaacatggaggagatcgtgaaggccctgccatctaatatggtggaagtgatggcctacaccgaccccacagccaggcagagcaccatggaggcccacgtgctgcccgaagtgatctacgtggagctgaagagcaagaagcggccactgaacagaatgaaggccttcgccgagccctgtaaccgcaatatcgccgagaagtccgccaagaagctggccgattacatcaattgcaccaacgagaaggccgacctgggcatcacaaatgccctgtggtattgtgaggatgagagcgtgaaggccccagagaatgtgaccgtggtgaactccatcaaggagctggagcagaagctgaatgagtggatgaacgagtaa

SEQ ID NO: 142 - DNA, 483 bp, Lachnospiraceae bacterium KH1T2
  misc_feature (1)..(483): Cas5
atgaagatcaagatcgtgctggagggagcattccaggcctggggagtgccttccgagtatacctggcggggcacatcttactatccaaccgccagaggcatcgtgggcctgatcggctgctgtatgggcatccctaggggcgacgatcgcctggagcagctgctgtccgtgctgaagatcacctacgacatcaacgaggacgataacggcaatcggaagtctggcagcatcctgacagattttcaggtggtgagaaaggaggacggaggcaagctgaatgcagcaaacggaggaaccggcgatagctacggcatcatcctgcacaagtcttatatcaatgacgccagcttcacagtgcacatcgagggccctgacgatctgatgaaggacgtgtacgatgccatgctggaccccgtgtgggtgccttatctgggcagaaagaattgccctccaaccgagccactgatccccgagattgaataa

SEQ ID NO: 143 - DNA, 618 bp, Lachnospiraceae bacterium KH1T2
  misc_feature (1)..(618): Cas6
atgtacctgaccaagctggagctgaatatccagaacaaggccgtgctgcacaatatgtctaactgcgagtggatgcacaagctgatcctggagaagggctttggccacatccaggccgagaatgcccggcagacactgaagatcctgtacgccgtggatggcatcaaggtgtatgtgcagtccgccgtggagcccaagttcgagaactgttcttactggatcagcacccctgccacaatctgcatcgacgccatgaagaagatctgtggcaccggcatggccgtgcactttaagtgcacctgtaaccccacaaagaagctgatcgatggcggcaagagaatcttcctgagctccgagcgggagagagacgagtggatcaagagagtgatggagagaagcggcgccgaggtgctggtggagtctcagaccagcgatttcacagtgtggggcatgaagaaggacaagaagaccgataagtcccacaagatctacgccaaggccgtgacctattctggcgccctgaagatcacagacgaggagaagttttgggaggccttctgcaatggcatcggccgggagaaggcctacggctgtggcatgctgatgatccaagtctaa

SEQ ID NO: 144 - protein, 566 aa, Lachnospiraceae bacterium KH1T2
  misc_feature (1)..(566): Cas8
MCDQQYVSTLNVLKDPWIPVVFLDGKIKDVGIIECFRNAEKIKTISNSKPYEKIAILRFLTAFITDVYQLDRRIERQKLYDAGSFEIERIENYVKECEEKNGASFVLGDSQRSFFCFNYNPQVDTEGVKLSAAYLHLELPHGNNPIHIVAQREEDFEGDTLPQFLRAALAFNLFPTGNMLKGANSKTGDNCYIDGVGKDGKPKYTAAYGSMGINAGSSMAAAEPVFFWPECDNLFHTLVMCMRSQGELQNNLKLNDPPAFWNADAEPNPKAGKRGDIVTSVSFVSGLAFQARRIVPVIENGKVYECYISNGYTNSNENVWHDPFAVRLRNHKSGEIFQMPAKGDREMWRNIGNLTASREESWHLMPDVLRPIKKSADATDYYENISSLAMIPMTQNAGYSAMFYDDTVQIPKEYLEDSYLGEYLTTRMEIVEEISKMWDKLKISALLDNKDKFSGHYRDDALQEYWVKIHQFLFDGDDSFLNHVIRMYHEDSSSFEKTADKALFEYLTKSVKEICEKEEKNTNSWNMLVKIIRQIHGKNGCLHIFYGTLKKYWKKEGKDKNDTGSI

SEQ ID NO: 145 - protein, 165 aa, Lachnospiraceae bacterium KH1T2
  misc_feature (1)..(165): Cse2
MIQEAYEKLAHEEKRLFAHCAGKLIKDAPKAIIPFYKVVPSEIESKNGKKYTVDEDAFFAALCVRCLFEKIEGVTLEPDILISEGRKNPKISLEGYDRRISALMSNTEAEFFIPKLAKLMNYTLKITSNKIPDCDQLYWDIHNIGSNEKDVQRRWARTIYVNNEE

SEQ ID NO: 146 - protein, 395 aa, Lachnospiraceae bacterium KH1T2
  misc_feature (1)..(395): Cas7
MSNSKYQFLNGKKLAEFHMLKLYPSSALNRDDAGEQKTGMYNGTLRNRISSQCIKRSWRLSETFEDVFDEIGIRTKRMPEYVGKKLVENGVPEEDVISFKKILSGEKVDEKSSKKSKADQAIDEGKPVKTAALSFYSVEELDKIAEICKRIYDDLEEPKSKNLKTIKIDNIQKEMRKCVHPMNIDVAAFGRMVTDNMLRPVEGAMQVAQALSTNAAVKENDYFVACDDLVKGETIEDVGGEMLGDIDYNSACYYIHANADLEQFAENLKDCENMEEIVKALPSNMVEVMAYTDPTARQSTMEAHVLPEVIYVELKSKKRPLNRMKAFAEPCNRNIAEKSAKKLADYINCTNEKADLGITNALWYCEDESVKAPENVTVVNSIKELEQKLNEWMNE

SEQ ID NO: 147 - protein, 160 aa, Lachnospiraceae bacterium KH1T2
  misc_feature (1)..(160): Cas5
MKIKIVLEGAFQAWGVPSEYTWRGTSYYPTARGIVGLIGCCMGIPRGDDRLEQLLSVLKITYDINEDDNGNRKSGSILTDFQVVRKEDGGKLNAANGGTGDSYGIILHKSYINDASFTVHIEGPDDLMKDVYDAMLDPVWVPYLGRKNCPPTEPLIPEIE

SEQ ID NO: 148 - protein, 205 aa, Lachnospiraceae bacterium KH1T2
  misc_feature (1)..(205): Cas6
MYLTKLELNIQNKAVLHNMSNCEWMHKLILEKGFGHIQAENARQTLKILYAVDGIKVYVQSAVEPKFENCSYWISTPATICIDAMKKICGTGMAVHFKCTCNPTKKLIDGGKRIFLSSERERDEWIKRVMERSGAEVLVESQTSDFTVWGMKKDKKTDKSHKIYAKAVTYSGALKITDEEKFWEAFCNGIGREKAYGCGMLMIQV

SEQ ID NO: 149 - DNA, 90 bp, Lachnospiraceae bacterium KH1T2
  misc_feature (1)..(90): CRISPR
gtattccccacgcacgtgggggtaaatccgctgagtttaattacgcagcggaagccggagcggtattccccacgcacgtgggggtaaatc

SEQ ID NO: 150 - DNA, 1524 bp, Klebsiella pneumoniae strain VRCO0172
  misc_feature (1)..(1524): Cas8
atggagaaccgcttcaatttgattgatgaaccctggattgcggtcgtggatgtggggttggtcagtttaaccgatattttcagccagccggaattacgcgctttaggtgggaatccggtagaaaaaatcgcgctcactaaattgctactcgccatcgcccaggcagcagcgacgccgacagatgatagcgactggcagcagatgggctggcagggaatggcccattgctgcctgcagtaccttgctaaatggcatgaccgtttttatctgtatggcgaaaagccgttcttacagatgcccgctattcaggccgcggaatgtaagtcattgggagtattatcaccggaggtgagtaccggcaataccaccgttttgaccgaaagtcagcaacagcagcaattaactgatgcagacaaagcgctagctattgttatgcaaatgggctttgggctcggaggcaagaaaaccgataactctgtggtattaacgccgggctatcggggtaaacaaaacgacaagggaaagccgggcagtggaaaggccggggtttctgtcgggcatatgggattgttacattcgttctggcaggggaattcaatcgtacagagcatttggctcaatttgtttaccgctgaggatattacgcagctggcgatgtatcccacgctggggactgctccctgggagcgaatgccgacaggggaagatgatgacattgcgcgctcgttgaaagcgtcgttgctgggccgcttgatcttgatgggtaaattttgtctgttagctgaggacggcattcactatagcgatggaataagccatgccggttatctggagggcaaaaccgacccctcggtgtccgtcgatttttcaggaaagaaaccaaaggcgttatgggttaatccgggtaaacgcccctggcgcgaactgacgtcgttattgcagtttattgagcaagatagcccccggggatatgaaacccgtcagcttagccttcctctgaagcggataacccatcatgcggagcagtttgcgctatggtcaggcggcttaagggtgagtagtaatgcgggggaacagtacgcttcagggaccgatgattatgttcagtcagaaatatggttgtcatcagatttaatcaatcacacatttttagagtatttaaaatatgaaatgacgcagcttgatgctgtgcaaaaacagctttggggtgcagttgtacgttattttcgccagctatcagatattgataaatcagcgacagggaaggctcaaccctttgtggcaaagcaggccgaaaaagcgacgacgatattctggcaactttgtgaacgtcaggctcagaccctaattaatgcttgcttgaattccggtgaagaccataccgcgcgtcttcagttacgaaaaatttttgccaggtacgccgggcaggtttttgatcagctctgtcccgccgacagtgcccgtcaattagatgcctgggcgctggcccggcctaatttttcccaatatctcaccctcgattaa

SEQ ID NO: 151 - DNA, 567 bp, Klebsiella pneumoniae strain VRCO0172
  misc_feature (1)..(567): Cse2
atggatcaggttcctgcagacgttaccgccgaaagcgccggtaacgaatcgcctgccaaacgatttgtcggttacgtgattgagcgtatcgcgaaagacaatggctttgccgcccgccttaaacgagcggataacccggcgaccgagtatcagagctgggaaatcctggcggggtttggcattgacctggaaaaagagtggcaacgcctgccgtactgcgtcattggcgccgcgctggcaaaggcgaaaccggccagcaatggcacaatcactctgggggccgccattgccggttgttatcccgaaggcaatcagtctgaacaggcgaaagctcgcctgcgacggctgttggcctgtacttcgaccagcgaagcgtgccgtattttgcgcccgttgttggcattaatggccagccgcagtgtgacgccggatttcgcagggctactcaacgaactgcagtggttctccggcagcagtcgcgaacggatccgcgcccgctgggcgcaggaattctatcgtcgtgccggtgaggctgccgggagtgaggcgaggaattcacatgactga

SEQ ID NO: 152 - DNA, 1035 bp, Klebsiella pneumoniae strain VRCO0172
  misc_feature (1)..(1035): Cas7
atgactaccccgttcagaaacacccgtattgagtttcatattctgcagtctttcccggtgacctgccttaaccgcgatgacgtgggcgcccccaagtccgccatcgttggcggtgtgtcgcgcgccagagtgtcatcgcagtgctggaagcgccaggtgcgtctggcgctgcctgattttggtattcgtctcggggtgcgtagtaaaaaaactgcctcactgctggccaacgcctgtcgcgcactgggagcgagcgaagaacaggccaccggatgcggtgaagcgatggccgcttttttctccgatgataccctgctgtttctcagcgaggctgaggccgccgcatttgccgcttatgcgcagggaaaagattttgacgccgccagcctgaaagacaaagagctggtcaaagtcgccaaaaaggtggttaacaataccctggatgccctggatattgcgcttttcgggcgcatggtggccaaagcggcggatatgaacgttgaggcggcggcatcgttcgcgcatgccatttccacccataaagtgagtaatgagatcgagttttttaccgccgtggatgactgtaaaacggaggatgaaagcggttcggcacatatgggcagcctggagtttaattcggcgacctactatcgctatgtcagcttggatctcgggcaactggcgcagacgttgggtgaggacgccgatatgaaaaccgccgtcgccgcttttgttaaggcactctatgtcgccgtcccctcagcccgacagacaacgcagtccggggcctgcccgtgggaatatgcccgcgtgttactgcgtaaaggtcagggtctgcaggcttcattcgagcagccagttaagagtcagggtgaaggcttcttatctcccagtaaagcggcgctcaaaaactggttgcatacaaaagaaaaactctctggctccttgttcggcaaacaaggcgattatgagtggggtgaggacctcgactacagcattgaccgcctgatcgctgacttacagtcacatctgtaa

SEQ ID NO: 153 - DNA, 717 bp, Klebsiella pneumoniae strain VRCO0172
  misc_feature (1)..(717): Cas5
atgagacaaactacgcaatatatgctgctgtggcttgaagggccgctgcagtcctgggggggcgattcaaagttcggtgtgcgcgatacgctgaatttcccgactcgctcgggcattctggggctgatttgctgtgcacgaggcgccgcggggccagaggtcgagtggctggcggagatgaataacctgccgatggaggttcgcgcctacgcccgaaccgacaaggagggccagccgctcctgcgcgagccgacattgtgcgatttccagatggttggcagcggatatgacgacagcgatccgtggcaaagtctgctgatccctaaaacatccgatggaaagaaagccgtagggggtggaacgaaaatgacctaccgccactatctccaggatgccgtattcgccgtggtaatgggacttggcagccagcaagccgagtcgttaccagaggcgctacaaaatccggtatgggatttatatctcggtcgtaaaagctgcgtgcccagcgagctgatctatcagggcatctatgacagcgcagaagcggcatggcagcaggccaggacattagctgagagtaagcggcgcacgctgagttacaaggtcattgaaggggaaggggatggcgatgtcatcacgcttaatgatgtcccggtgcagttcggccggcataagcgttaccgggatcgtcaggtgaccgtgctggagtgcggctaa

SEQ ID NO: 154 - DNA, 648 bp, Klebsiella pneumoniae strain VRCO0172
  misc_feature (1)..(648): Cas6
atgactgacctctttgcgagtgctttacatctcgatcgcgctgcggtgaaagcgctgaaaataagcgatgcctactccctacaccgggtggtgtacagcctgtttgctgacgcgcgtacagaccgggagaagtgcagccatatttcgagcgggatcgcctatgccgaccagggcggggattttcatggccgcaaaatattgatcgtctctgacagacttccggctgcaaaggttgatggcctgtacggtgaggtcatcagtaaatcgattccggccgcctttctctcccattcgcgttatcgctttcaggtacaagtgaatccggtacggaaagataagcaaacgggtaaacgcgtcgcggtgaaaggccgggccgatattgcgcagtggtttattcagcgagccgccagccgctggggctttgacgttgaccttcctggcttgcaggttgaggcgatggaagtgctgcagtttaaagataaaggcggccgccaggtaacgcttggcaaggcgacggtgcaggggctgctcaccgtcaccgaccgacagaagttccagcatagttttcatcatggcattggtaaagggcgagcctttggctgcggcctgctgcagattgtgcccgttgttgatgcgcttttttcctga

SEQ ID NO: 155 - DNA, 1524 bp, Klebsiella pneumoniae strain VRCO0172
  misc_feature (1)..(1524): Cas8
atggagaacaggttcaatctgatcgacgagccctggatcgccgtggtggatgtgggcctggtgtccctgaccgacatcttttctcagccagagctgcgcgccctgggaggaaatcctgtggagaagatcgccctgacaaagctgctgctggcaatcgcacaggcagcagcaacccctacagacgattccgactggcagcagatgggatggcagggaatggcacactgctgtctgcagtacctggccaagtggcacgatcggttctacctgtatggcgagaagcccttcctgcagatgcctgccatccaggcagcagagtgcaagtccctgggcgtgctgagccctgaggtgtccaccggcaacaccacagtgctgacagagtctcagcagcagcagcagctgaccgatgccgacaaggccctggccatcgtgatgcagatgggcttcggcctgggcggcaagaagaccgacaacagcgtggtgctgacacccggctatcggggcaagcagaatgataagggcaagcctggcagcggcaaggcaggcgtgtccgtgggacacatgggcctgctgcactccttctggcagggcaactctatcgtgcagagcatctggctgaatctgtttaccgccgaggacatcacacagctggccatgtacccaaccctgggcacagccccatgggagagaatgcccaccggcgaggacgatgacatcgccagatccctgaaggcctctctgctgggcaggctgatcctgatgggcaagttctgtctgctggccgaggatggcatccactacagcgacggcatctcccacgccggctatctggagggcaagaccgatcccagcgtgtccgtggacttcagcggcaagaagcctaaggccctgtgggtgaatccaggcaagagaccctggagggagctgacatctctgctgcagtttatcgagcaggacagcccacgcggctatgagacccggcagctgagcctgcccctgaagagaatcacacaccacgcagagcagtttgcactgtggtccggcggactgagggtgagctccaacgcaggagagcagtacgccagcggcaccgatgactatgtgcagtccgagatctggctgtctagcgacctgatcaatcacaccttcctggagtacctgaagtatgagatgacacagctggatgcagtgcagaagcagctgtggggagcagtggtgcgctactttcggcagctgtccgatatcgacaagtctgccacaggcaaggcacagcccttcgtggcaaagcaggcagagaaggccaccacaatcttttggcagctgtgcgagaggcaggcacagaccctgatcaacgcctgtctgaatagcggcgaggaccacacagccagactgcagctgaggaagatctttgccagatatgccggccaggtgttcgatcagctgtgccctgccgactccgccaggcagctggatgcctgggcactggcccggccaaacttctctcagtacctgaccctggattaa

SEQ ID NO: 156 - DNA, 567 bp, Klebsiella pneumoniae strain VRCO0172
  misc_feature (1)..(567): Cse2
atggatcaggtgcctgcagacgtgacagcagagtctgccggcaatgagagcccagccaagcggttcgtgggctatgtgatcgagcggatcgccaaggataacggatttgcagcacgcctgaagagggcagacaatccagccaccgagtatcagtcctgggagatcctggccggcttcggcatcgacctggagaaggagtggcagcgcctgccatactgcgtgatcggagccgccctggcaaaggcaaagcctgcctctaacggaaccatcacactgggagcagcaatcgcaggatgttaccccgagggcaatcagagcgagcaggcaaaggcaaggctgcggagactgctggcatgcacctccacatctgaggcctgtagaatcctgaggccactgctggccctgatggcaagccgctccgtgacccccgacttcgcaggactgctgaacgagctgcagtggtttagcggctctagcagggagcgcatccgggcaagatgggcacaggagttttataggagggcaggagaggcagcaggctctgaggccagaaacagccacgactaa

SEQ ID NO: 157 - DNA, 1035 bp, Klebsiella pneumoniae strain VRCO0172
  misc_feature (1)..(1035): Cas7
atgaccacacccttccgcaacacccggatcgagtttcacatcctgcagagcttccctgtgacatgcctgaatagagacgatgtgggagcaccaaagtctgccatcgtgggaggcgtgagccgggccagagtgagctcccagtgttggaagagacaggtgaggctggccctgcctgactttggcatcagactgggcgtgaggtctaagaagaccgccagcctgctggcaaacgcctgccgggccctgggagccagcgaggagcaggccaccggctgtggcgaggccatggccgccttcttttctgacgatacactgctgtttctgagcgaggcagaggcagcagccttcgccgcctacgcccagggcaaggattttgacgccgccagcctgaaggacaaggagctggtgaaggtggccaagaaggtggtgaacaataccctggatgccctggacatcgccctgttcggcagaatggtggccaaggcagcagatatgaacgtggaggcagcagcctcctttgcccacgcaatctccacacacaaggtgtctaatgagatcgagttctttaccgccgtggacgattgcaagacagaggacgagtccggctctgcccacatgggcagcctggagttcaactccgccacctactatagatacgtgtccctggatctgggacagctggcacagaccctgggagaggatgccgacatgaagacagccgtggccgcctttgtgaaggccctgtacgtggcagtgccatccgccagacagaccacacagtctggcgcctgtccttgggagtatgcccgcgtgctgctgcggaagggacagggactgcaggccagcttcgagcagcctgtgaagtcccagggcgagggctttctgagcccatccaaggccgccctgaagaattggctgcacaccaaggagaagctgtctggcagcctgttcggcaagcagggcgactacgagtggggcgaggatctggactatagcatcgatcgcctgatcgcagacctgcagtcccacctgtaa

SEQ ID NO: 158 - DNA, 717 bp, Klebsiella pneumoniae strain VRCO0172
  misc_feature (1)..(717): Cas5
atgaggcagaccacacagtacatgctgctgtggctggagggaccactgcagtcctggggaggcgactctaagtttggcgtgagagataccctgaatttccctacaaggtccggcatcctgggcctgatctgctgtgcaaggggagcagcaggccctgaggtggagtggctggccgagatgaacaatctgccaatggaggtgagagcctatgccaggaccgacaaggagggacagcctctgctgagggagccaacactgtgcgatttccagatggtgggcagcggctacgacgattccgacccctggcagtctctgctgatccctaagaccagcgatggcaagaaggcagtgggaggaggaaccaagatgacatacaggcactatctgcaggatgccgtgtttgcagtggtcatgggactgggcagccagcaggcagagtccctgcctgaggccctgcagaacccagtgtgggacctgtacctgggccggaagtcttgcgtgcctagcgagctgatctaccagggcatctatgattccgccgaggcagcatggcagcaggcaagaaccctggccgagagcaagcggagaacactgtcctataaagtgatcgagggcgagggcgatggcgacgtgatcaccctgaacgacgtgcctgtgcagttcggccgccacaagaggtaccgcgataggcaggtcaccgtgctggagtgcggataa

SEQ ID NO: 159 - DNA, 648 bp, Klebsiella pneumoniae strain VRCO0172
  misc_feature (1)..(648): Cas6
atgaccgatctgtttgcatctgccctgcacctggacagggcagcagtgaaggccctgaagatctccgatgcctactctctgcaccgggtggtgtatagcctgttcgcagatgcaaggacagacagggagaagtgctcccacatctcctctggcatcgcatacgcagatcagggaggcgactttcacggacgcaagatcctgatcgtgagcgacaggctgccagcagcaaaggtggatggactgtacggcgaagtgatctctaagagcatccctgccgcctttctgtcccacagccggtataggttccaggtgcaagtgaatccagtgaggaaggacaagcagaccggcaagagagtggccgtgaagggcagggccgatatcgcacagtggttcatccagagggcagcatcccggtggggctttgatgtggacctgccaggactgcaggtggaggcaatggaggtgctgcagttcaaggacaagggaggccgccaggtgaccctgggcaaggcaacagtgcagggactgctgaccgtgacagatagacagaagtttcagcactctttccaccacggaatcggcaagggaagggccttcggctgcggactgctgcagatcgtgccagtggtggacgccctgtttagctaa

SEQ ID NO: 160 - protein, 507 aa, Klebsiella pneumoniae strain VRCO0172
  misc_feature (1)..(507): Cas8
MENRFNLIDEPWIAVVDVGLVSLTDIFSQPELRALGGNPVEKIALTKLLLAIAQAAATPTDDSDWQQMGWQGMAHCCLQYLAKWHDRFYLYGEKPFLQMPAIQAAECKSLGVLSPEVSTGNTTVLTESQQQQQLTDADKALAIVMQMGFGLGGKKTDNSVVLTPGYRGKQNDKGKPGSGKAGVSVGHMGLLHSFWQGNSIVQSIWLNLFTAEDITQLAMYPTLGTAPWERMPTGEDDDIARSLKASLLGRLILMGKFCLLAEDGIHYSDGISHAGYLEGKTDPSVSVDFSGKKPKALWVNPGKRPWRELTSLLQFIEQDSPRGYETRQLSLPLKRITHHAEQFALWSGGLRVSSNAGEQYASGTDDYVQSEIWLSSDLINHTFLEYLKYEMTQLDAVQKQLWGAVVRYFRQLSDIDKSATGKAQPFVAKQAEKATTIFWQLCERQAQTLINACLNSGEDHTARLQLRKIFARYAGQVFDQLCPADSARQLDAWALARPNFSQYLTLD

SEQ ID NO: 161 - protein, 188 aa, Klebsiella pneumoniae strain VRCO0172
  misc_feature (1)..(188): Cse2
MDQVPADVTAESAGNESPAKRFVGYVIERIAKDNGFAARLKRADNPATEYQSWEILAGFGIDLEKEWQRLPYCVIGAALAKAKPASNGTITLGAAIAGCYPEGNQSEQAKARLRRLLACTSTSEACRILRPLLALMASRSVTPDFAGLLNELQWFSGSSRERIRARWAQEFYRRAGEAAGSEARNSHD

SEQ ID NO: 162 - protein, 344 aa, Klebsiella pneumoniae strain VRCO0172
  misc_feature (1)..(344): Cas7
MTTPFRNTRIEFHILQSFPVTCLNRDDVGAPKSAIVGGVSRARVSSQCWKRQVRLALPDFGIRLGVRSKKTASLLANACRALGASEEQATGCGEAMAAFFSDDTLLFLSEAEAAAFAAYAQGKDFDAASLKDKELVKVAKKVVNNTLDALDIALFGRMVAKAADMNVEAAASFAHAISTHKVSNEIEFFTAVDDCKTEDESGSAHMGSLEFNSATYYRYVSLDLGQLAQTLGEDADMKTAVAAFVKALYVAVPSARQTTQSGACPWEYARVLLRKGQGLQASFEQPVKSQGEGFLSPSKAALKNWLHTKEKLSGSLFGKQGDYEWGEDLDYSIDRLIADLQSHL

SEQ ID NO: 163 - protein, 238 aa, Klebsiella pneumoniae strain VRCO0172
  misc_feature (1)..(238): Cas5
MRQTTQYMLLWLEGPLQSWGGDSKFGVRDTLNFPTRSGILGLICCARGAAGPEVEWLAEMNNLPMEVRAYARTDKEGQPLLREPTLCDFQMVGSGYDDSDPWQSLLIPKTSDGKKAVGGGTKMTYRHYLQDAVFAVVMGLGSQQAESLPEALQNPVWDLYLGRKSCVPSELIYQGIYDSAEAAWQQARTLAESKRRTLSYKVIEGEGDGDVITLNDVPVQFGRHKRYRDRQVTVLECG

SEQ ID NO: 164 - protein, 215 aa, Klebsiella pneumoniae strain VRCO0172
  misc_feature (1)..(215): Cas6
MTDLFASALHLDRAAVKALKISDAYSLHRVVYSLFADARTDREKCSHISSGIAYADQGGDFHGRKILIVSDRLPAAKVDGLYGEVISKSIPAAFLSHSRYRFQVQVNPVRKDKQTGKRVAVKGRADIAQWFIQRAASRWGFDVDLPGLQVEAMEVLQFKDKGGRQVTLGKATVQGLLTVTDRQKFQHSFHHGIGKGRAFGCGLLQIVPVVDALFS

SEQ ID NO: 165 - DNA, 89 bp, Klebsiella pneumoniae strain VRCO0172
  misc_feature (1)..(89): CRISPR
gtcttccccacacgcgtgggggtgtttccggctcttttttatctccttcatccttcgctatgtcttccccacacgcgtgggggtgtttc

SEQ ID NO: 166 - DNA, 1569 bp, Pseudomonas aeruginosa DHS01
  misc_feature (1)..(1569): Cas8
atgactgaacactacaacctgctggataccccctggctgccggtccgcctggcgaacggcgaggtccgcgagatggggctgctggaggtgtaccgcgaggccgagcgtatcagcgccctggcggaaaccgagccgccgagtctgattgcacagtaccgcctgctgctggccattacccaccgggcgcttttgctggagtacggcgcgtggaaggatagtggcaggctgcgttggttccgcgaggggttgcccattgacgtcgtggaacgctacctggagcgttggcgagagcgtttctggctgttccatccacagtatccgttcatgcaagtcgcggccttggctagcgccgcggaaacctgcgacaaacagaagccctgggcccagatttccctggccagcgccaacggcaatacccctgtcgtgttcgaccactcctatgacctggcgccttccgcggtgagtgcggaccgggcgttgtgcgccttgctgggcttcctacagttcactccgggcgggttggtcaagactgttcgcgattcggacaaagccggcgcactggccaatacggcggcggtggtacccctggcggacagtctggcgaaaaccctgtgcctggccttgcacccggcctcgggcgaagcagccttcgatttgcctgcctgggagcgggaagccttgacgattccgcaactggccgccgaccccattcttgccagcgggcctaacgatcgctacacccggcagtcgcgagcagtgttgttgctgccggaggaagagggctgcgtccgctggattcgtttcgccgccggccaggcgctggccgacgatgtccaggcgccggaccccatggccagctaccgccccggcgccaacaacagcatggtccggctgagcttcggtgaagggcgggtgttctggcgcgacctgccgagcttgctgccggacagcgcggcggctggctcgaaacgggctgccgttctcgactgggcttccaacctgcgcagcatcggcgccgatgcgccgtcctcgatgctgctggtcgccggattggccagcgaccaggccaaactgttgcgctggcgctccgagaccgttgtcctgcctgcggccctgctcgactcggagggctgtgccaacgaactgcgccgttgtatccgggaatcggaagacctgtacggcgaactgcgcaagatcgccgtggcaatgctcgccgaggcgttgcccgatcctgccagcaaggacacctgggcgagggctcgtacgtcgtttgacaacggtccggctgcggccacctatttcgccttgctggagcgctcgttgccctcgctcatggccctcatcggcggcgataggttggagatgctggacgaagccgaggcgttctggcgaagccgcctgctggcagccctcgaggtcgcctggcagggcgtgcgggaaggcctgggcctgtcggtcgcagcgttgcgtgcggaggccaaggtccggccgcgctacctggcgttgctgcgtcgttaccgtagcgaacgtacctcttccactccacttgcagaggagcagtgtgcatga

SEQ ID NO: 167 - DNA, 531 bp, Pseudomonas aeruginosa DHS01
  misc_feature (1)..(531): Cse2
atgagtgctgccgaacatcctttcatcggccatctgcagcgcttgcagaatgatcgcggtgcgctggccgttctacggcgcagcctgggcttcgcgccgggtgcctatgtgccggcctatccctatgtggaacgcttcgtcggtgccgagaggcatgcgcaggatgcctggcgcctggcactgtatctgaccgccggattgttcgccagccatcccggacaggggcgggcgagcctggcgatgcgcttcggcgaactgatgaaagcgcgcaacagcgcgagcatcgaaaagcgtttcatcgccttgctggctgccgatgcggaaaacctgccggtgtatctgcgccaggccgtgagcctgttggcggcggacaagctcgccttcgactatggcgccttgctcgacgaccttgcccattggctcgacccttacctgcctgttgcgcgcggcgacgccattcgccagcgctgggccagggatttctacgcggcgctggccaacacaaccgacacctcccttcacaaggattga

SEQ ID NO: 168 - DNA, 1143 bp, Pseudomonas aeruginosa DHS01
  misc_feature (1)..(1143): Cas7
atgaatttgttcatcgagttccatctgatccagaacttcgctccgtccaacctcaaccgtgacgataccggagcgcccaaggatgccatctttggcggtcaccgtcgggctcgcgtcagcagccagtgcttcaagcgtgcgatccgcctgactgcccacgagcaggagttggtcgcgcccgaacatcgcggcgtgcgcaccaagaagctcaaggcattgctgctggagcggcttgccggacgcgatcccgccgaggccgagggcaagatcgagacggcgctggcggccgcggggctcaagctcaaggacgatggcaagaccgaatacctgctgtttctcggcgaagcggagattgccggtttcgccgcgctgatcgagcagcgctgggatgaactgggcagcgccgcgccggctggcgagaaaaagggcaagaaggaagccaaggcgaacgtgccgacggaagtgatcaagcaggccagggccctgctcgacggtggcaaggccgttgacgtggcgctgttcgggcggatgctcgccgatctgcccgaagtcaatcaggacgcggcctgccaggtggcccatgcgatcagtacccatcgtgtcgagcgcgagttcgattacttcaccgccgtcgacgatcgcggtggcccggacgaaagcggcgccggcatgatcggccaggtggagttcaattccgccacgctgtatcgctacgcagtggtcgacctgcgcaagttgctcggcaacctgcagaacgacggcgagctggtgctgtcggcgctggaagcgttcacccaggccatggtccgggcgatcccgtcgggcaagcagaacaccttcgcggcgcacaacctgccggccttcgtcggtatctgcttgcgccacgcgggcccgctgaacctggccaacgcctttgagaaaccggtcgtcgcgcgtgccgatgcctccctcagcgagcgctccgttgccgagttggcccgccacgaccagcaattggcctcggtctatggtgacagccgcgaccgctgggcttatctggacatcagcggtgcctggccgaaggagcgtggcgagccggccggcaacctgcagcaactcgccgattggctgcgcagccaggtttccagccgtctgggaggctga

SEQ ID NO: 169 - DNA, 663 bp, Pseudomonas aeruginosa DHS01
  misc_feature (1)..(663): Cas5
atggctaccttgctgatgcgcctgcaagggccgatgcagtcatggggcaccaccagccgttttgacgagcgcgacactcagctggaaccgtcgaagtcgggagtgcttggcctggtctgcgccgccctgggacgtgatcgcagcgagccgctggaggatctggccagcctgcggatgggggtgcgcgtcgaccgagagggcattccgttgcgcgactaccagacggccaccggtgtgctggtcgccagtggcaaggccgatccgcggcggacagtggtcagcccgcggcattacctggccgacgcggtctttctggtcgggctcgaagggcgcgaccaggccctgctggagcgaatccagcaagccttgcgtgcaccgttctggccgctgtgcctgggccgcaagagtttcgttcctgggagcccggtgtggttgcccgagggcctttcttccctggcactggaacaggcgttgcaggcctggccacgcctggccgaggcgcaaccgggcgaccgcggcaagcccttgcgttgcctgatcgaggatgagcgcagcggggtggtacgcctcgatcagcccatcgccccctttgccgaacgccgtttcggcccacgcttcgtacgctcgggagtcgcggatgtacctgaccagactgacccttga

SEQ ID NO: 170 - DNA, 612 bp, Pseudomonas aeruginosa DHS01
  misc_feature (1)..(612): Cas6
atgtacctgaccagactgacccttgatcctcgcagcgctcaggcgcgccgcgacctaggcgacgcctatgagatgcaccgtactttgtcgcgggttttcgccgacgagcaggctccggcatcgcgcttcctctggcgtctggaggcctcggggaatgcctggtccactccgaccttgctggtccaggcggccagcgagggtaactggtcggtgctgcaggcgctccctggctacctgctgggggagccgcagagcaaatctctggctttgcgacagtggctggaaagcgatatctcctaccgtttcagattgttcgccaatccgacggtgacacgccagggcaagcgctatgggctggtgggcgaggagcagcaactggcttggctggcacgccagggcgagcggcacggtttcgtggtcgaggcggccctcgtaaccttcagcgaagtgcttggcagccgcaagaggcagacacgcatcagcgtcttgcgcgccgcgttcgaggggcgtttgcggatcagtcgcccggatgcctttggtcaggctctggtcgctgggataggccctgccaaggctttcggctgtggcctgctgagcctggcgcgtagctga

SEQ ID NO: 171 - DNA, 1569 bp, Pseudomonas aeruginosa DHS01
  misc_feature (1)..(1569): Cas8
atgaccgagcactataacctgctggacacaccatggctgcctgtgcggctggcaaatggagaggtgagagagatgggcctgctggaggtgtacagggaggcagagaggatctctgccctggcagagaccgagccacccagcctgatcgcccagtaccggctgctgctggccatcacacacagagccctgctgctggagtatggagcatggaaggactccggccggctgagatggtttagggagggcctgcctatcgatgtggtggagcggtacctggagcggtggagggagcggttttggctgttccacccacagtatcccttcatgcaggtggccgccctggcaagcgccgcagagacctgcgataagcagaagccatgggcacagatcagcctggcatccgccaacggcaatacacctgtggtgttcgatcactcctacgacctggccccatctgccgtgagcgccgaccgggccctgtgcgcactgctgggctttctgcagttcaccccaggaggactggtgaagacagtgcgcgacagcgataaggcaggcgccctggcaaacaccgcagcagtggtgccactggcagacagcctggcaaagacactgtgcctggccctgcacccagcatccggcgaggcagcctttgatctgcctgcctgggagagagaggccctgaccatcccacagctggcagccgaccctatcctggcatccggcccaaatgatcgctatacacggcagagccgggccgtgctgctgctgcccgaggaggagggctgcgtgcggtggatcagattcgcagcaggacaggccctggcagacgatgtgcaggcccctgacccaatggccagctacaggcctggcgccaacaattccatggtgcgcctgtcttttggcgaaggccgggtgttctggagagatctgcctagcctgctgccagactccgccgcagcaggctctaagagggcagccgtgctggactgggcaagcaacctgcgctccatcggagcagatgcacctagctccatgctgctggtggcaggactggcaagcgatcaggccaagctgctgagatggaggtccgagaccgtggtgctgccagccgccctgctggactctgagggatgcgcaaacgagctgcggagatgtatccgggagagcgaggatctgtatggcgagctgagaaagatcgcagtggcaatgctggcagaggccctgcccgatcctgcatctaaggacacctgggcaagggcacggaccagcttcgacaatggaccagcagcagcaacatacttcgcactgctggagaggtccctgccttctctgatggccctgatcggcggcgatcgcctggagatgctggacgaggcagaggccttctggagatctaggctgctggccgccctggaggtggcatggcagggcgtgcgggagggactgggcctgagcgtggccgccctgagagcagaggcaaaggtgcgcccaaggtacctggccctgctgaggcgctatcggagcgagagaacctctagcacacccctggccgaggagcagtgcgcctaa

SEQ ID NO: 172 - DNA, 531 bp, Pseudomonas aeruginosa DHS01
  misc_feature (1)..(531): Cse2
atgtccgccgcagagcacccattcatcggacacctgcagaggctgcagaatgacaggggcgccctggccgtgctgaggcgcagcctgggatttgcacctggagcatatgtgccagcatacccatatgtggagcggttcgtgggagcagagagacacgcacaggatgcctggaggctggccctgtacctgaccgcaggactgtttgcatcccacccaggacagggaagggcctctctggcaatgaggttcggagagctgatgaaggccaggaacagcgcctccatcgagaagcggttcatcgccctgctggcagcagacgcagagaatctgcccgtgtatctgagacaggccgtgagcctgctggcagcagataagctggccttcgactacggcgccctgctggacgatctggcacactggctggacccctatctgccagtggcaaggggcgacgcaatcaggcagcggtgggccagagacttctacgccgccctggccaacaccacagatacctctctgcacaaggactaa

SEQ ID NO: 173 - DNA, 1143 bp, Pseudomonas aeruginosa DHS01
  misc_feature (1)..(1143): Cas7
atgaacctgtttatcgagttccacctgatccagaattttgccccatccaacctgaatagggacgataccggagcaccaaaggacgcaatctttggaggacacaggagagccagagtgagctcccagtgcttcaagagagccatcaggctgaccgcccacgagcaggagctggtggcccccgagcacaggggcgtgcggacaaagaagctgaaggccctgctgctggagaggctggcaggacgcgatcctgcagaggcagagggcaagatcgagaccgccctggcagcagcaggcctgaagctgaaggacgatggcaagacagagtacctgctgtttctgggagaggcagagatcgcaggattcgccgccctgatcgagcagcggtgggacgagctgggcagcgccgcaccagccggcgagaagaagggcaagaaggaggccaaggccaacgtgcccaccgaagtgatcaagcaggcaagggccctgctggatggaggcaaggcagtggacgtggccctgttcggaaggatgctggccgatctgccagaggtcaatcaggacgcagcatgtcaggtggcacacgcaatctccacccacagggtggagagggagtttgactacttcacagcagtggacgataggggaggccccgatgagtctggcgcaggaatgatcggccaggtggagtttaacagcgccaccctgtacagatatgcagtggtggacctgcgcaagctgctgggaaacctgcagaatgatggagagctggtgctgtccgccctggaggccttcacccaggcaatggtgcgcgcaatcccatctggcaagcagaacacatttgccgcccacaatctgcctgccttcgtgggaatctgcctgaggcacgcaggaccactgaacctggccaatgcctttgagaagccagtggtggcaagggcagacgcctccctgtctgagcggagcgtggcagagctggcaagacacgatcagcagctggcaagcgtgtacggcgacagccgggatagatgggcctatctggacatctccggcgcatggccaaaggagagaggagagccagcaggaaacctgcagcagctggccgattggctgaggtctcaggtgtctagccgcctgggaggataa

SEQ ID NO: 174 - DNA, 663 bp, Pseudomonas aeruginosa DHS01
  misc_feature (1)..(663): Cas5
atggccaccctgctgatgaggctgcagggaccaatgcagtcctggggaaccacatctcggttcgacgagagagatacacagctggagccttctaagagcggcgtgctgggactggtgtgcgccgccctgggaagggatagaagcgagccactggaggacctggcctccctgcggatgggcgtgcgcgtggatagggagggcatccccctgagagactatcagaccgcaacaggcgtgctggtggcatccggcaaggccgatcccaggagaaccgtggtgtctcctcggcactacctggccgacgccgtgtttctggtgggcctggagggcagagatcaggccctgctggagagaatccagcaggccctgagagcaccattttggcctctgtgcctgggaaggaagagcttcgtgccaggctcccccgtgtggctgcctgagggactgtcctctctggccctggagcaggccctgcaggcctggccaagactggcagaggcacagcctggcgacaggggcaagccactgagatgtctgatcgaggacgagaggagcggcgtggtgcgcctggatcagcctatcgcaccattcgccgagaggcgctttggaccaagattcgtgaggtccggcgtggcagacgtgcccgatcagaccgacccttaa

SEQ ID NO: 175 - DNA, 612 bp, Pseudomonas aeruginosa DHS01
  misc_feature (1)..(612): Cas6
atgtatctgaccaggctgaccctggacccccgcagcgcccaggcacggagagatctgggcgacgcctacgagatgcacaggaccctgagccgcgtgtttgcagacgagcaggcaccagcatcccggttcctgtggagactggaggcctctggcaacgcctggagcacccctacactgctggtgcaggcagcatccgagggaaattggtctgtgctgcaggccctgccaggatacctgctgggagagccacagtccaagtctctggccctgaggcagtggctggagtctgacatcagctacaggtttcgcctgttcgccaatcccaccgtgacaaggcagggcaagcggtacggactggtgggagaggagcagcagctggcatggctggcaaggcagggcgagagacacggctttgtggtggaggccgccctggtgaccttcagcgaggtgctgggctcccggaagagacagacacggatctccgtgctgagagccgcctttgagggcaggctgcgcatctctcgcccagatgccttcggccaggccctggtggcaggaatcggacccgccaaggccttcggctgcggcctgctgtccctggcaaggagctaa

SEQ ID NO: 176 - protein, 522 aa, Pseudomonas aeruginosa DHS01
  misc_feature (1)..(522): Cas8
MTEHYNLLDTPWLPVRLANGEVREMGLLEVYREAERISALAETEPPSLIAQYRLLLAITHRALLLEYGAWKDSGRLRWFREGLPIDVVERYLERWRERFWLFHPQYPFMQVAALASAAETCDKQKPWAQISLASANGNTPVVFDHSYDLAPSAVSADRALCALLGFLQFTPGGLVKTVRDSDKAGALANTAAVVPLADSLAKTLCLALHPASGEAAFDLPAWEREALTIPQLAADPILASGPNDRYTRQSRAVLLLPEEEGCVRWIRFAAGQALADDVQAPDPMASYRPGANNSMVRLSFGEGRVFWRDLPSLLPDSAAAGSKRAAVLDWASNLRSIGADAPSSMLLVAGLASDQAKLLRWRSETVVLPAALLDSEGCANELRRCIRESEDLYGELRKIAVAMLAEALPDPASKDTWARARTSFDNGPAAATYFALLERSLPSLMALIGGDRLEMLDEAEAFWRSRLLAALEVAWQGVREGLGLSVAALRAEAKVRPRYLALLRRYRSERTSSTPLAEEQCA

SEQ ID NO: 177 - protein, 176 aa, Pseudomonas aeruginosa DHS01
  misc_feature (1)..(176): Cse2
MSAAEHPFIGHLQRLQNDRGALAVLRRSLGFAPGAYVPAYPYVERFVGAERHAQDAWRLALYLTAGLFASHPGQGRASLAMRFGELMKARNSASIEKRFIALLAADAENLPVYLRQAVSLLAADKLAFDYGALLDDLAHWLDPYLPVARGDAIRQRWARDFYAALANTTDTSLHKD

SEQ ID NO: 178 - protein, 380 aa, Pseudomonas aeruginosa DHS01
  misc_feature (1)..(380): Cas7
MNLFIEFHLIQNFAPSNLNRDDTGAPKDAIFGGHRRARVSSQCFKRAIRLTAHEQELVAPEHRGVRTKKLKALLLERLAGRDPAEAEGKIETALAAAGLKLKDDGKTEYLLFLGEAEIAGFAALIEQRWDELGSAAPAGEKKGKKEAKANVPTEVIKQARALLDGGKAVDVALFGRMLADLPEVNQDAACQVAHAISTHRVEREFDYFTAVDDRGGPDESGAGMIGQVEFNSATLYRYAVVDLRKLLGNLQNDGELVLSALEAFTQAMVRAIPSGKQNTFAAHNLPAFVGICLRHAGPLNLANAFEKPVVARADASLSERSVAELARHDQQLASVYGDSRDRWAYLDISGAWPKERGEPAGNLQQLADWLRSQVSSRLGG

SEQ ID NO: 179 - protein, 220 aa, Pseudomonas aeruginosa DHS01
  misc_feature (1)..(220): Cas5
MATLLMRLQGPMQSWGTTSRFDERDTQLEPSKSGVLGLVCAALGRDRSEPLEDLASLRMGVRVDREGIPLRDYQTATGVLVASGKADPRRTVVSPRHYLADAVFLVGLEGRDQALLERIQQALRAPFWPLCLGRKSFVPGSPVWLPEGLSSLALEQALQAWPRLAEAQPGDRGKPLRCLIEDERSGVVRLDQPIAPFAERRFGPRFVRSGVADVPDQTDP

SEQ ID NO: 180 - protein, 203 aa, Pseudomonas aeruginosa DHS01
  misc_feature (1)..(203): Cas6
MYLTRLTLDPRSAQARRDLGDAYEMHRTLSRVFADEQAPASRFLWRLEASGNAWSTPTLLVQAASEGNWSVLQALPGYLLGEPQSKSLALRQWLESDISYRFRLFANPTVTRQGKRYGLVGEEQQLAWLARQGERHGFVVEAALVTFSEVLGSRKRQTRISVLRAAFEGRLRISRPDAFGQALVAGIGPAKAFGCGLLSLARS

SEQ ID NO: 181 - DNA, 91 bp, Pseudomonas aeruginosa DHS01
  misc_feature (1)..(91): CRISPR
gtgttccccacatgcgtggggatgaaccgggcaccatcggcgccattgaccgcgcgctgaaggtgttccccacatgcgtggggatgaaccg

SEQ ID NO: 182 - DNA, 1668 bp, Streptococcus thermophilus strain ND07
  misc_feature (1)..(1668): Cas8
atgagtcggtttaatttacttgatgaaccctggatttctgttatttatgacgagaaaggatccacaaaagatgtttctttacaggatttatttacaaatgctcatcagtataaagaattagcaggagatacgaaaacacaagattttgcggtattacgagtattgttggctgttttgcatacagttttttcccgatttgatatagatggaaatgcttatgagtatcttactattgatgaaggatggaatcagcttgaaccagtggatgagatggatattgagaattatgaagaagctctttatgaaacatgggaaaaactttggactaataaaagatttccaaatattgttaatcaatacttagaaaaatggcgagatcgcttttacttatttgaccaaaagtatccattttttcaggtaacgaaagaagatattgctggagataaaattagcaaagccaaaggaactagtattttgggtaaaaatataaatagaattatatctgagagtggaaataagatagctttattttccccaaaagatgaagaaaataaaaatactctaactgccgcagaattagctagatggctaattacatttcaagggtattcaggagtatccgataaggtcatttttggaaatgaaaaatatacaccttcgaaaggatggctatttgatattggtgctatttatattaaaggtaacactttattcgaaacgttgttactaaattatatttcaccgtataatgaatgtggtaatgtagaaaatattcagcgaccttgctgggaacgtaaaagttctgatatcattaaaagttaccttgatgaaaaagatattaccaatatagctagtttatatactgtttggagtaaaggaatctatattgacccagactttaatttaaataaacctttctcttttgatattgtgaaattacctgatatcaatcatagggataattttttggagccaatgacactttggaagtataatgtttcgggtaaaaatagggatagctatacaccaaagaaacatcttttgaatcagtctttatggcgatcttttggcttgttatctataaaagatactgatcttcaacatagaaaacctggcgttatcgaatggcttacatatattgatgatataataggaaatcgactatcaaacattgttgcaattagtatgcaggacgatggaaaccctcaatcacggcttccaacggatgaggttattgactcaatttttatcaatgatttggttttaacggatttagacgagggtggttgggttcctcgtatcaatgaagtagtagaagaaacaaaaaaaattatttctagaacatataaaacgtatattaatgatataaaggaaatcagaaatatctctaatggtagttatactcagcagatagttgaaagtctatatttcaaaatcgatcaacctttccgacaatggttagctagcattcaaccagaagatgataaagattctaagatacaagaatggagagttttactgaagaaaatagttaaagctgaagcagaagttattttacatcaagggggggcgagggattatcttggtatccaaaaagatgggcgaattaagaatattgcaactgcctataattcgttcgatttttggcttcgtcaacagttaaaatag

SEQ ID NO: 183 - DNA, 594 bp, Streptococcus thermophilus strain ND07
  misc_feature (1)..(594): Cse2
atgtcacaacatactaaacaaacagtttggactgttacaaagaagattattttcaaattgagtaaccaaaaagaggaaacatatgataaagctacactagcaaaagttagaaaaacattggggaaacccttgagtgaagcaacagaaatatggccaattctgttcgaaaatttaccagaggaatttttaagttcgtatcagcaaccaagctatgaggaattagctatttatacagcgcttcaattgtatgcattgcatcagcaaggtgtttcaacaagtgtgatgctagatgattctaagccctatgaaaatataggttctgcacttggtaagcttaggaaagaagatgataccacttcaattgatagacgattcaataccatgattacctcatcaacgtttgaagaacttacttatcatttaaggcatttgatttcgctacttaaagtggagtcaccggtgattcaggttgattactctggcctagcaaatgatttatattggtttttaaataatagtcaagaaaatgtccgcctaaattgggcaagagcatattataaacaaattaaaggagaaaaaaacaatgacaactga

SEQ ID NO: 184 - DNA, 1068 bp, Streptococcus thermophilus strain ND07
  misc_feature (1)..(1068): Cas7
atgacaactgaacaacgattatttttagatattcatgctattcaaagcttaccaccttcaaatatgaatagagatgatacaggtagcccgaaaacagctcagtatggaggagttagaagatctcgcgtaagttctcaagcatggaagaaagcgatgagagagtattttaatactcatggtgatcattcaaatgttggtattagaacaaaagaaattgtgagatatgttgcagataaaatagtagaactagatagttctatcagtattgaagatgctttggaaaaagccgataaagtcttgatagctgctggaatcaagaaaaaaggtgaagttaaagcactttattttatgggtgatagtcaagctaagaagttagctcaagcagcctatgacaatataacacataaaaaagagcttcaaaagttggctaatgaagatccagctattgatattgccctgtttggtcgaatggtagccgaagatccaactcttaacgaggattcttcttctcaggttgcacatgccatttccacacatccagtacaaactgaatttgatttctttacggctgttgatgatttagctccagaggataatgcaggggcgggtatgcttggaactgttgagtttaattcttctacactatatcgctatgcaaatgttgcgattcatgaattgtcaaaacaattaggaaacaaggaatcgttggagaatagtttatctttgttcattgaggcttttgcaaagtcacttccaacagggaaagtaaatacatttgctaatcaaacgctaccacagactttaattgtaacggttcgaagtgatcgtccggttaatcttgtcagtgcatttgaagaaccagttaaatcaatagaaggctatgttactaaatctatcgataaactcgccaaagagtttattaaggttgagaaatttgtagacaaaccacttatgaccttctatgttactttgcatgagagcgacagtctaaaacaaattggggaggaaaaagattcagtttcaaaattattggaagatttttcagaaatgatagcccaatatatttaa

SEQ ID NO: 185 - DNA, 726 bp, Streptococcus thermophilus strain ND07
  misc_feature (1)..(726): Cas5
atgaagacgatattgttgaaatttgctggccccttacaatcatggggaacgagttcacattttgaaactaggcatacagatttttatccttccaaaagtgcggtaattggactacttgctgctagtttaggttataggagagacgaagatgaaaaaattcaaaaattaaatgaacttgattttgctgttcgtgtcgatcagcaaggaaatctgttaagagacttccatgttgcacagaagtatacagaaaagggtaaatttgatagaaattatgttacgaatcggtattatctagaagacgctgtatttgttgtagccctctcccatacagatgatagctttatagatatcattaaaggtgctctaaaaaatccctatttccaaccttttatggggagaagggcactcccaataactgcagactttatcttaggtgagacagatgttaatccattagagagcctaaaatcgctgaaatggcaagcttctctatggtttatgaaaaaatctcatgataaggatgctatttctttggaagtttatctagatagtcaattagtcaacaaggatgtttatcagctgaggcaagattatgttaggtcattttcacaaaaagggagaagatttggttttaggtatgaagtacgtgaattaatcagtgttcaaaatcctcactatttaaataagaatacagagcataacattttcgagagtataggagattga

SEQ ID NO: 186 - DNA, 639 bp, Streptococcus thermophilus strain ND07
  misc_feature (1)..(639): Cas6
atgtacatttctagggtagaaattgatcgatataatagacgaaaggttagagatttaacgcatgtaggagcttatcatgcttgggtggaagagagttttccatcggaattagagcaatcaatccgtacaagaaaattatggcgaatcgatcgtattcaaggtaaggattatcttattattgtaagtaaagaaaaacctaatttacaaaaacttgaaaaatatggtgttgtaggaagcgctcaaactaaggactatcaacattttttagatagcatcaaaactggttttcgaatgaattttagaatagtgctaaatccggttatttcaattacttcacccgataaatcaaaacgaggagttgtaaaaccgcatgtgacgattaaacatcagatggactttctagtgaaacaatctgagaaaaatggcttctcattagtaggagaaagtttctcaattgttgaacgtggttatgaagtttttcagaaaccagaaaaacccatacgactatcaaaagttgtttacgaaggaaccttaactgttagtgatgatacgcttttcaaaaaaatgctgaccgagggagttggaaagaaaaaagcatatggttttggcttgatgacagtggtaccacttgaggaatga

SEQ ID NO: 187 - DNA, 1668 bp, Streptococcus thermophilus strain ND07
  misc_feature (1)..(1668): Cas8
atgtccaggttcaacctgctggatgagccatggatctccgtgatctatgacgagaagggcagcaccaaggacgtgtccctgcaggatctgtttacaaatgcccaccagtacaaggagctggccggcgacaccaagacacaggatttcgccgtgctgcgggtgctgctggccgtgctgcacaccgtgtttagcagattcgacatcgatggcaacgcctacgagtatctgacaatcgacgagggctggaatcagctggagcctgtggacgagatggatatcgagaactacgaggaggccctgtatgagacctgggagaagctgtggacaaataagcggttcccaaacatcgtgaatcagtacctggagaagtggcgggaccggttctacctgttcgatcagaagtatcccttctttcaggtgaccaaggaggacatcgccggcgataagatcagcaaggccaagggcacatccatcctgggcaagaacatcaatagaatcatctctgagagcggcaacaagatcgccctgttctccccaaaggacgaggagaacaagaataccctgacagcagcagagctggcaaggtggctgatcacctttcagggctactctggcgtgagcgacaaagtgatcttcggcaacgagaagtatacacccagcaagggctggctgtttgatatcggcgccatctacatcaagggcaataccctgttcgagacactgctgctgaactacatctccccatataatgagtgcggcaacgtggagaatatccagcggccctgttgggagagaaagagctccgatatcatcaagtcttacctggacgagaaggatatcaccaatatcgcctctctgtacacagtgtggagcaagggcatctatatcgaccccgacttcaacctgaataagcccttttccttcgacatcgtgaagctgccagacatcaaccacagggataatttcctggagcccatgaccctgtggaagtacaacgtgtccggcaagaatcgcgattcttatacacccaagaagcacctgctgaaccagtctctgtggaggagctttggcctgctgagcatcaaggacaccgatctgcagcaccgcaagcctggcgtgatcgagtggctgacatacatcgacgatatcatcggcaaccggctgagcaatatcgtggccatctccatgcaggacgatggcaatccacagagcagactgcccaccgacgaagtgatcgattccatcttcatcaacgacctggtgctgacagacctggatgagggcggctgggtgcccagaatcaatgaggtggtggaggagaccaagaagatcatctcccggacatacaagacctatatcaacgatatcaaggagatcagaaacatctccaatggctcttacacccagcagatcgtggagagcctgtacttcaagatcgaccagcccttcagacagtggctggcctccatccagcctgaggacgataaggattctaagatccaggagtggagggtgctgctgaagaagatcgtgaaggccgaggcagaagtgatcctgcaccagggaggagccagggattatctgggcatccagaaggacggccgcatcaagaacatcgccaccgcctacaatagctttgacttctggctgaggcagcagctgaagtaa

SEQ ID NO: 188 - DNA, 594 bp, Streptococcus thermophilus strain ND07
  misc_feature (1)..(594): Cse2
atgtctcagcacaccaagcagacagtgtggaccgtgacaaagaagatcatcttcaagctgtccaatcagaaggaggagacctacgataaggccacactggccaaggtgcgcaagaccctgggcaagcctctgtctgaggccacagagatctggcctatcctgtttgagaacctgccagaggagttcctgagctcctaccagcagccatcctatgaggagctggccatctacaccgccctgcagctgtatgccctgcaccagcagggcgtgtctacaagcgtgatgctggacgattctaagccttatgagaacatcggcagcgccctgggcaagctgcgcaaggaggacgataccacaagcatcgacaggcgctttaataccatgatcacatctagcaccttcgaggagctgacctaccacctgcggcacctgatctccctgctgaaggtggagtctccagtgatccaggtggactactccggcctggccaacgatctgtattggttcctgaacaattctcaggagaacgtgaggctgaattgggcccgcgcctactataagcagatcaagggcgagaagaacaatgacaactaa

SEQ ID NO: 189 - DNA, 1068 bp, Streptococcus thermophilus strain ND07
  misc_feature (1)..(1068): Cas7
atgaccacagagcagagactgtttctggacatccacgccatccagagcctgcccccttccaacatgaatcgggacgataccggctcccctaagacagcccagtatggcggcgtgcggagatctagggtgagctcccaggcctggaagaaggccatgcgcgagtacttcaacacccacggcgatcacagcaatgtgggcatcaggacaaaggagatcgtgcgctatgtggccgacaagatcgtggagctggattctagcatctccatcgaggacgccctggagaaggccgataaggtgctgatcgccgccggcatcaagaagaagggcgaggtgaaggccctgtacttcatgggcgattcccaggccaagaagctggcacaggcagcatacgacaacatcacccacaagaaggagctgcagaagctggccaatgaggaccccgccatcgatatcgccctgttcggaaggatggtggcagaggaccctaccctgaacgaggattcctctagccaggtggcacacgcaatcagcacccacccagtgcagacagagtttgatttctttaccgcagtggacgatctggcccccgaggacaatgcaggagcaggaatgctgggaaccgtggagttcaactcctctacactgtaccggtatgccaatgtggccatccacgagctgtctaagcagctgggcaacaaggagagcctggagaattctctgagcctgtttatcgaggccttcgccaagtccctgcctaccggcaaggtgaacacatttgccaatcagacactgccacagaccctgatcgtgacagtgaggtccgaccgcccagtgaacctggtgtctgccttcgaggagcccgtgaagagcatcgagggctatgtgaccaagtccatcgataagctggccaaggagtttatcaaggtggagaagttcgtggacaagcccctgatgaccttttacgtgacactgcacgagtccgattctctgaagcagatcggcgaggagaaggatagcgtgtccaagctgctggaggacttcagcgagatgatcgcacagtacatctaa

SEQ ID NO: 190 - DNA, 726 bp, Streptococcus thermophilus strain ND07
  misc_feature (1)..(726): Cas5
atgaagaccatcctgctgaagtttgcaggacctctgcagtcctggggcacatcctctcactttgagacaagacacaccgacttctatccatccaagtctgccgtgatcggactgctggcagccagcctgggataccggagagacgaggatgagaagatccagaagctgaatgagctggacttcgccgtgcgggtggatcagcagggcaacctgctgagagactttcacgtggcccagaagtacaccgagaagggcaagttcgatcggaactatgtgacaaatagatactatctggaggacgccgtgtttgtggtggccctgtcccacaccgacgattctttcatcgatatcatcaagggcgccctgaagaacccctactttcagcctttcatgggcaggcgcgccctgcctatcaccgcagactttatcctgggcgagacagatgtgaatccactggagagcctgaagtccctgaagtggcaggcctctctgtggttcatgaagaagagccacgacaaggatgccatctccctggaggtgtacctggactctcagctggtgaacaaggacgtgtaccagctgcggcaggactacgtgcggagcttcagccagaagggccggagattcggctttaggtacgaggtgcgcgagctgatctccgtgcagaaccctcactatctgaacaagaataccgagcacaatatcttcgagagcatcggcgactaa

SEQ ID NO: 191 - DNA, 639 bp, Streptococcus thermophilus strain ND07
  misc_feature (1)..(639): Cas6
atgtacatcagcagggtggagatcgatcgctataataggaggaaggtgcgcgacctgacccacgtgggagcatatcacgcctgggtggaggagtcttttccaagcgagctggagcagtctatcaggacacgcaagctgtggcggatcgacagaatccagggcaaggattacctgatcatcgtgagcaaggagaagcccaatctgcagaagctggagaagtacggagtggtgggcagcgcccagactaaggactatcagcacttcctggattccatcaagacaggctttcggatgaacttcagaatcgtgctgaatcccgtgatctccatcacctctcctgacaagagcaagcggggcgtggtgaagccccacgtgacaatcaagcaccagatggattttctggtgaagcagtctgagaagaacggctttagcctggtgggcgagtctttcagcatcgtggagaggggctatgaggtgttccagaagcctgagaagccaatccgcctgtctaaggtggtgtacgagggcaccctgacagtgagcgacgataccctgtttaagaagatgctgacagagggcgtgggcaagaagaaggcctacggcttcggcctgatgaccgtggtgcccctggaggagtaa

SEQ ID NO: 192 - protein, 555 aa, Streptococcus thermophilus strain ND07
  misc_feature (1)..(555): Cas8
MSRFNLLDEPWISVIYDEKGSTKDVSLQDLFTNAHQYKELAGDTKTQDFAVLRVLLAVLHTVFSRFDIDGNAYEYLTIDEGWNQLEPVDEMDIENYEEALYETWEKLWTNKRFPNIVNQYLEKWRDRFYLFDQKYPFFQVTKEDIAGDKISKAKGTSILGKNINRIISESGNKIALFSPKDEENKNTLTAAELARWLITFQGYSGVSDKVIFGNEKYTPSKGWLFDIGAIYIKGNTLFETLLLNYISPYNECGNVENIQRPCWERKSSDIIKSYLDEKDITNIASLYTVWSKGIYIDPDFNLNKPFSFDIVKLPDINHRDNFLEPMTLWKYNVSGKNRDSYTPKKHLLNQSLWRSFGLLSIKDTDLQHRKPGVIEWLTYIDDIIGNRLSNIVAISMQDDGNPQSRLPTDEVIDSIFINDLVLTDLDEGGWVPRINEVVEETKKIISRTYKTYINDIKEIRNISNGSYTQQIVESLYFKIDQPFRQWLASIQPEDDKDSKIQEWRVLLKKIVKAEAEVILHQGGARDYLGIQKDGRIKNIATAYNSFDFWLRQQLK

SEQ ID NO: 193 - protein, 197 aa, Streptococcus thermophilus strain ND07
  misc_feature (1)..(197): Cse2
MSQHTKQTVWTVTKKIIFKLSNQKEETYDKATLAKVRKTLGKPLSEATEIWPILFENLPEEFLSSYQQPSYEELAIYTALQLYALHQQGVSTSVMLDDSKPYENIGSALGKLRKEDDTTSIDRRFNTMITSSTFEELTYHLRHLISLLKVESPVIQVDYSGLANDLYWFLNNSQENVRLNWARAYYKQIKGEKNNDN

SEQ ID NO: 194 - protein, 355 aa, Streptococcus thermophilus strain ND07
  misc_feature (1)..(355): Cas7
MTTEQRLFLDIHAIQSLPPSNMNRDDTGSPKTAQYGGVRRSRVSSQAWKKAMREYFNTHGDHSNVGIRTKEIVRYVADKIVELDSSISIEDALEKADKVLIAAGIKKKGEVKALYFMGDSQAKKLAQAAYDNITHKKELQKLANEDPAIDIALFGRMVAEDPTLNEDSSSQVAHAISTHPVQTEFDFFTAVDDLAPEDNAGAGMLGTVEFNSSTLYRYANVAIHELSKQLGNKESLENSLSLFIEAFAKSLPTGKVNTFANQTLPQTLIVTVRSDRPVNLVSAFEEPVKSIEGYVTKSIDKLAKEFIKVEKFVDKPLMTFYVTLHESDSLKQIGEEKDSVSKLLEDFSEMIAQYI

SEQ ID NO: 195 - protein, 241 aa, Streptococcus thermophilus strain ND07
  misc_feature (1)..(241): Cas5
MKTILLKFAGPLQSWGTSSHFETRHTDFYPSKSAVIGLLAASLGYRRDEDEKIQKLNELDFAVRVDQQGNLLRDFHVAQKYTEKGKFDRNYVTNRYYLEDAVFVVALSHTDDSFIDIIKGALKNPYFQPFMGRRALPITADFILGETDVNPLESLKSLKWQASLWFMKKSHDKDAISLEVYLDSQLVNKDVYQLRQDYVRSFSQKGRRFGFRYEVRELISVQNPHYLNKNTEHNIFESIGD

SEQ ID NO: 196 - protein, 212 aa, Streptococcus thermophilus strain ND07
  misc_feature (1)..(212): Cas6
MYISRVEIDRYNRRKVRDLTHVGAYHAWVEESFPSELEQSIRTRKLWRIDRIQGKDYLIIVSKEKPNLQKLEKYGVVGSAQTKDYQHFLDSIKTGFRMNFRIVLNPVISITSPDKSKRGVVKPHVTIKHQMDFLVKQSEKNGFSLVGESFSIVERGYEVFQKPEKPIRLSKVVYEGTLTVSDDTLFKKMLTEGVGKKKAYGFGLMTVVPLEE

SEQ ID NO: 197 - DNA, 89 bp, Streptococcus thermophilus strain ND07
  misc_feature (1)..(89): CRISPR
gtttttcccgcacacgcgggggtgatcctatacctatatcaatggcctcccacgcataagcgtttttcccgcacacgcgggggtgatcc

SEQ ID NO: 198 - DNA, 1743 bp, Streptomyces sp. S4
  misc_feature (1)..(1743): Cas8
ttgcccgggaagggtggggcgtcggtgaatctgttatctgatgggtggctttcagctgtttccgcaggtgggggctctggtttcgggggtggtcctggggcggggccggcggagttcggtgtgcgggagcttctgctgaatgcggagaagttcgctgacatcgtggtggacctgcccacgcagcgtccggcggtgttccggcaggtcctgctgccgttggtggtggacgcgttggggtgtccgaaggacgccgaggcgtggatggacatgttccgggcgggggctttcagccctgagcagcggcaggtgctggctgattacctggacaagcaccagcatttgttcggtcttctggatccggtggagccgttcggtcaggtggctgacctgcggacggcgaagggggagaccaaggggtcggcgttgctggtggcgacggcggccaccgggaacaacgtgccgttgttctcgtcccggacggagggcgacgtactggagctgacgcccgctgaggcggccaggtggctgctgcacacccactgctgggacacggctgccatcaagaccggcgcggtcggtgacccgatggtgaagtccgggaagacgaccggcaatccgacgggcccgctgggtcagctcggcgtgaccatgccggtggggtcgacgcttttcgagacgttgttgctcaacatcccgtacggccaggctgggctgtccgacgacgtgccgcagtggcgacggcgtagtacgcagggcgacgtcaaggacactctctcgtgtgcgacgcctgtgtggcagagcagaccggcgcgggggctgctggaggcgtggacgtggcaggctcgccggatccgtctcatctctcaggacaccgaccgggggccgcgcatcacccgggtgctggtcgcggccggcgaccgtcttgaggtcagcccggacacggaaccgcacacggcctgggtggtggacagccccgccggccggcggggtaagagtcccgcgcggtctggggtgaagagtgcgcgtccgcgccgtcacacggcaggccgcgccgggtggcgtggtcttgacgcgctgctggccgtgaacgctgtcgaccaggaccagcaggcgaccgccacccgcagcggggcggtgagcagccagctggtgcggcagctcagcgccatcagccgccgcttgcccagccggtatccgctgcgggtcgagctgaccgggatcgcctacggcaaccagtcggccgtcatcgaggacatgtacttcgacgagatcccgctgcccgtggccgctctcgacccggaggggatcgtctacggggcgctgctggaggtggtcgaccaggcggaggacctggccaaggcggtcaatcacctgtcgggggaccttcgccgggccgcgggcagtgaaccgatcccgtgggacaagggccagcgtcccggagacaccctgttgcacgctctcgacccgatcgtgcggcgtctgttggccggcctgcgccaggccggcgacgacttcgaccggtgtgagcagggactggaggcgtgggagcacaaggccgggcaggccacgctccgcgtcgcggagggcctgttcaattcggcgcccgccgccctgttcaccggccgccgcgtcaagaaggacggcaaggagcaggtctaccgtctcagcactgccgaagcgtccttccgccggcggctcgccgtgatcctccaccgccgcgccgctgcacgtactgccggctga

SEQ ID NO: 199 - DNA, 615 bp, Streptomyces sp. S4
  misc_feature (1)..(615): Cse2
gtgtccacctcacccttgtccgctcccgtccccggccagagagtttcctccctgcccaggccctactggagcggccgtgcggacgagcaaggccagtggcggacacgcgccggggaatccctgcgaccgcccggggaggacctcagcgcgctgagagccggcctgggaaagaaggcgttcaccgaaccccgcctgtggcagtactacacgacacccaccgacggccgcgtcaccctcgagctggaggccgagcacgccgcgctcgccctgtacgggctgcatcagcaaagccaggagcagccgatgcaccggcagggtgtccgcaccggcagggccctgcgcgccctgcaccagcggtacagcgaagaggcgaccgaccggcgggtggcgcaggccgtcggtgcgacctcggctgcggccttcgcctaccggctccgcgcactggtgacgcagttgcgttccatcgggcagcccctggactacgaccagctgatgcaggacctcctgcgctggcacttccccgacggacgctcccgggtccgccgcgggtggggtcttggctaccacggccgcgatcgccagcccgacgaagccccgccccccgaaggctcgtag

SEQ ID NO: 200 - DNA, 1167 bp, Streptomyces sp. S4
  misc_feature (1)..(1167): Cas7
atgtctcagcccgccgcccgcccgccgcgcacgtacgtcgacttccacatcctgcagacggtccccccggccaacctcaacagggacgaccagggcaaccccaaggaggcctactacggcggtgtccgccgctctcgtgtttcctcccaggcgtggaagcgtgccacccgcacccacttcgccgagcgggtccccgagcaggacctcgccacccgcacccgcaggatcatcggcgccctcgccgatgacatccagaagcgcgccggcctggaccgcccggcagcgctgcgcctggccgacgcgctgctggcgccgttggagctgagcggcggcaagaagaaggacgagtcggcctacctcctcttctacggccggcgccagctcgatgccgtagccgccctcgtcgccgaccaggcaaccgaactgtccgcgctgagcgacgccgacctcgcttcccgggtgaaggagctcccggttcgtgagcagttcagcacgggccacccgatcgatgtcgcccttttcgggcgcatggtcgcggacatccccgctctcaaggtcgacgccgcggcgcaggtcgcccatgccctgtccacccacgcggtggagctcgagttcgactacttcacggccgtcgacgatgagcagaccgacgaggagaccggtgccggcatgatcggcaccatcggcttcaactccgccaccctctaccgctacgcctccgtcggcctccaccagctcctggacaatctcaccgacgaggaagcggccctcaccgccatcagcgagttcgccacgtccttcgcgcgctccatgcccaccggctaccagaactcctttgcccaccgcaccctgcccagcctcgtcgccgtcgtcgtccgcgaagaccagcccgtcaacctcgtctccgcgttcgaacaaccggtggccaccccctcgggcatcgccgccgcctccgccgcgcggctcgccgaggaacacacacgcgccaccgtcacatggggcgacgctccggccttcgcagccgccacccacgtgttcaccgaccaccagaagaccaccgccgccctcaacagcgcgttcggcccctccatccccttctccgctctcctcgaaggcctgcacacccacctggccggagccctcaagcccaagcaggccgcgcagtga

SEQ ID NO: 201 - DNA, 882 bp, Streptomyces sp. S4
  misc_feature (1)..(882): Cas5
gtgaccaccgcccccacccccgagcccgccggcaacacgcacccggcccacggcagcgacgaaccgaccgtgctgctgcttcgcctcgccggccctctgcagtcctggggcgtacgcagttccttcaaccgccgcgacaccggcgcggaacccaccaagtccggcgtcatcggcctgctggcggcagcggcaggacacccccgtgaacaacccctgggagagctcgcggacctgaccctcggtattcgcgtcgaccaaccaggcaccctgctgcgcgactaccacaccgtcagcgactaccgaggccgccccctgccgcaggcaggtgtctccgcgaaaggcatccagaagcccacctcaccggccaaacacacccacgtcaccacccgcttctacctccaggacgcggtattcgtcgccgccctcgaaggcccccccggcctcctcaccaccctggacagggcggtacgcaaccccgccttcccgctcgcactgggacgccgctcctgcccaccgacccaacccctcagcctcggcttgcgcaccaccgacatggaaaccgccctgcgcagcgagccctggcaggcctccgcccacacccgcgagcagtacgcccgccgcctgggccgagaacgcggcctccaccagcctcttcacccaggcaccatcgatcgcgcagccaccatcgaagacccccgcggcgacgaccgcctgcaggacgcacccgtctccttcgacccccaccagcgcgccttcaccagccgccaagtccgccacacctggctggccatccccaccggcttcgaccacatcgacgacgaccagccccacggccaggccgacgaccccgaccacgaccctttcgccctgctgggctggtga

SEQ ID NO: 202 - DNA, 813 bp, Streptomyces sp. S4
  misc_feature (1)..(813): Cas6
atgacctacctctcccgcatccgcatcaatcccctccgcaaggacagcaggaaactgctctccaacccccgtgccgtacacggcgccgtcatgggcggcctgcccaaccacaagcccgacgaccgcgtcctgtggcggatggaccccgacaacccccaccggccccacctcttcgtcctcagcccgacacgccctgactggacgcacatcatccaggactgcggatggccggacgcggacggtgaccatgccgccgtccgcgactacacccccctcctcagtcagctggccgtcggccgcgaattcgccttccgcctcaccgccagccccgtccagaacaccgccacccccacgaaggcgacacccgcccaggccgcccgcctgaccacccacgccgaaaacggcaaacgcatccgcggcttccgcatgggccaccgcacagcagccgcccaactcgactggttcctcacccggaccgaccgctggggcttcgacatccccgccacccgctccgatcccgccgcccccggcatccacgcccccacaccccccaccgcccctcgccccacctcgccaccccgcccagaccccaaccctccctacgaagtccgcatcaccgcccgccaccgccattccttccagaagaacggacacggagcgcacgtcgtcttccgcagcgcaaccttcgaaggccgcctgcgcatcaccgacaccgaccgcttcaccaccagcctcctcaccggcctcggcccctcccgcgcctacggctgcggcctgctcaccctcgccccgctgcccggacagcagacctga

SEQ ID NO: 203 - DNA, 1743 bp, Streptomyces sp. S4
  misc_feature (1)..(1743): Cas8
atgcctggcaagggaggagcaagcgtgaacctgctgtccgatggctggctgagcgccgtgtccgccggcggcggcagcggctttggaggaggacctggagcaggaccagcagagttcggcgtgcgcgagctgctgctgaatgccgagaagtttgccgacatcgtggtggatctgccaacccagaggcctgccgtgttccggcaggtgctgctgcctctggtggtggacgccctgggatgtccaaaggacgcagaggcctggatggatatgtttagggcaggagccttctcccccgagcagaggcaggtgctggccgactacctggataagcaccagcacctgtttggactgctggaccccgtggagccattcggccaggtggccgacctgagaacagcaaagggagagaccaagggcagcgccctgctggtggcaacagcagccaccggcaacaatgtgcccctgtttagctcccggacagagggcgacgtgctggagctgacccctgcagaggcagcaagatggctgctgcacacacactgctgggataccgcagccatcaagacaggagcagtgggcgaccctatggtgaagagcggcaagaccaccggaaacccaacaggacctctgggacagctgggagtgaccatgccagtgggctccacactgttcgagaccctgctgctgaatatcccatacggacaggcaggactgtctgatgacgtgccacagtggaggcgccggagcacccagggcgacgtgaaggataccctgtcctgtgcaacacccgtgtggcagagccggccagcaaggggactgctggaggcctggacatggcaggccagaaggatcagactgatctcccaggacacagatcgcggcccaaggatcaccagagtgctggtggcagcaggcgacaggctggaggtgtctccagatacagagccccacaccgcatgggtggtggatagcccagcaggccggagaggcaagtctcctgcacggagcggcgtgaagtccgccagaccaagaaggcacaccgcaggaagggcaggatggaggggcctggacgccctgctggccgtgaacgccgtggaccaggatcagcaggcaacagcaacccggagcggcgccgtgtctagccagctggtgagacagctgtctgccatcagccgccggctgcctagccggtacccactgagagtggagctgaccggcatcgcctatggcaaccagtccgccgtgatcgaggacatgtacttcgatgagatcccactgcctgtggccgccctggaccccgagggcatcgtgtacggcgccctgctggaggtggtggaccaggccgaggatctggccaaggccgtgaatcacctgtccggcgacctgagaagggcagcaggctctgagccaatcccatgggacaagggacagaggcctggcgataccctgctgcacgccctggacccaatcgtgcgccggctgctggcaggactgaggcaggccggcgatgactttgataggtgtgagcagggcctggaggcctgggagcacaaggcaggacaggccacactgcgggtggcagagggcctgtttaatagcgccccagccgccctgttcaccggcagaagggtgaagaaggacggcaaggagcaggtgtatcgcctgtctacagcagaggccagcttccgccggagactggccgtgatcctgcacaggcgcgccgccgcccggaccgccggctaa

SEQ ID NO: 204 - DNA, 615 bp, Streptomyces sp. S4
  misc_feature (1)..(615): Cse2
atgtccacatctccactgtctgcccccgtgcctggccagagagtgtctagcctgccaaggccatactggtccggcagggcagatgagcagggacagtggcggaccagagcaggagagagcctgaggccacctggagaggacctgtccgccctgagagcaggactgggcaagaaggccttcacagagccaaggctgtggcagtactataccacacccacagatggccgcgtgaccctggagctggaggcagagcacgccgccctggccctgtacggactgcaccagcagagccaggagcagccaatgcacaggcagggcgtgcggaccggaagagccctgagggccctgcaccagcggtactctgaggaggcaacagacaggcgcgtggcacaggcagtgggagccaccagcgccgcagcctttgcctataggctgcgcgccctggtgacccagctgaggtctatcggccagccactggattacgaccagctgatgcaggatctgctgaggtggcacttccccgacggccggagcagagtgcggagaggatggggactgggataccacggaagggacaggcagcccgatgaggccccaccccctgagggcagctaa

SEQ ID NO: 205 - DNA, 1167 bp, Streptomyces sp. S4
  misc_feature (1)..(1167): Cas7
atgtcccagccagcagcaaggccacctagaacatacgtggactttcacatcctgcagaccgtgccacccgccaacctgaatcgggacgatcagggcaacccaaaggaggcctactatggcggcgtgcggagatccagagtgagctcccaggcctggaagagggcaacccgcacacacttcgcagagcgggtgcccgagcaggatctggcaaccagaacaaggaggatcatcggcgccctggcagacgatatccagaagagggccggcctggataggcctgccgccctgaggctggcagacgccctgctggccccactggagctgtccggcggcaagaagaaggacgagtctgcctacctgctgttttatggccggagacagctggatgcagtggccgccctggtggcagaccaggcaaccgagctgtctgccctgagcgatgcagacctggcatcccgggtgaaggagctgcccgtgagagagcagttttctacaggccaccctatcgacgtggccctgttcggcaggatggtggccgacatccctgccctgaaggtggatgcagcagcacaggtggcacacgccctgagcacacacgccgtggagctggagtttgattacttcaccgccgtggacgatgagcagacagacgaggagaccggagcaggaatgatcggaaccatcggcttcaacagcgccacactgtaccgctatgcctccgtgggactgcaccagctgctggacaatctgaccgatgaggaggccgccctgacagccatctccgagtttgccacctccttcgcccggtctatgcccacaggctatcagaactcttttgcccacaggaccctgcccagcctggtggcagtggtggtgcgcgaggaccagcctgtgaatctggtgagcgccttcgagcagccagtggccacaccatccggcatcgcagcagcatctgccgcaaggctggccgaggagcacacccgcgcaaccgtgacatggggcgatgcaccagcctttgccgcagcaacacacgtgttcaccgaccaccagaagaccacagccgccctgaacagcgcctttggccctagcatcccattctccgccctgctggagggactgcacacccacctggcaggcgccctgaagcctaagcaggcagcacagtaa

SEQ ID NO: 206 - DNA, 882 bp, Streptomyces sp. S4
  misc_feature (1)..(882): Cas5
atgaccacagcacctacaccagagccagcaggaaatacccacccagcacacggctccgatgagcctaccgtgctgctgctgaggctggcaggaccactgcagtcttggggcgtgagatcctcttttaacaggagggacacaggagcagagccaaccaagtccggcgtgatcggactgctggcagcagcagcaggacaccctagagagcagccactgggagagctggcagatctgaccctgggcatcagggtggaccagccaggcacactgctgagggactaccacaccgtgagcgattataggggcagacctctgccacaggcaggcgtgtctgccaagggcatccagaagcccaccagccctgccaagcacacacacgtgaccacaaggttttacctgcaggatgccgtgttcgtggccgccctggagggacctccaggactgctgaccacactggacagggccgtgcggaatccagcattcccactggccctgggccggagaagctgtccacctacccagccactgtccctgggactgcggaccacagatatggagacagccctgagatctgagccttggcaggccagcgcccacaccagagagcagtatgcaaggcgcctgggaagggagaggggactgcaccagcctctgcacccaggaaccatcgacagggcagcaacaatcgaggaccccaggggcgacgataggctgcaggacgcacccgtgagctttgatcctcaccagagggccttcacctccagacaggtgaggcacacctggctggccatccccacaggctttgaccacatcgacgatgaccagcctcacggacaggcagatgaccccgatcacgaccctttcgccctgctgggatggtaa

SEQ ID NO: 207 - DNA, 813 bp, Streptomyces sp. S4
  misc_feature (1)..(813): Cas6
atgacatacctgtcccggatcagaatcaacccactgcggaaggacagccggaagctgctgagcaatccaagggcagtgcacggagccgtgatgggaggcctgccaaaccacaagcccgatgacagggtgctgtggcgcatggaccccgacaatcctcacaggccacacctgtttgtgctgagccccacacgccctgactggacccacatcatccaggattgtggctggccagatgcagacggcgatcacgcagccgtgagagactataccccactgctgagccagctggcagtgggaagagagttcgcctttaggctgacagcctcccccgtgcagaacaccgccacaccaaccaaggcaaccccagcacaggcagcaaggctgaccacacacgccgagaatggcaagcggatcagaggcttcagaatgggacacagaaccgcagcagcacagctggattggtttctgacacgcaccgaccggtggggcttcgatatccctgcaacaagatctgacccagcagcaccaggcatccacgcaccaacacctccaaccgcaccaaggcctacaagcccacctagaccagatcccaacccaccatacgaggtgcgcatcaccgcaaggcacagacactcctttcagaagaatggccacggcgcccacgtggtgtttcggtctgccaccttcgagggcaggctgcgcatcacagacaccgatcggttcaccacatctctgctgacaggcctgggccctagcagagcctatggatgcggactgctgacactggcacctctgccaggacagcagacctaa

SEQ ID NO: 208 - protein, 580 aa, Streptomyces sp. S4
  misc_feature (1)..(580): Cas8
MPGKGGASVNLLSDGWLSAVSAGGGSGFGGGPGAGPAEFGVRELLLNAEKFADIVVDLPTQRPAVFRQVLLPLVVDALGCPKDAEAWMDMFRAGAFSPEQRQVLADYLDKHQHLFGLLDPVEPFGQVADLRTAKGETKGSALLVATAATGNNVPLFSSRTEGDVLELTPAEAARWLLHTHCWDTAAIKTGAVGDPMVKSGKTTGNPTGPLGQLGVTMPVGSTLFETLLLNIPYGQAGLSDDVPQWRRRSTQGDVKDTLSCATPVWQSRPARGLLEAWTWQARRIRLISQDTDRGPRITRVLVAAGDRLEVSPDTEPHTAWVVDSPAGRRGKSPARSGVKSARPRRHTAGRAGWRGLDALLAVNAVDQDQQATATRSGAVSSQLVRQLSAISRRLPSRYPLRVELTGIAYGNQSAVIEDMYFDEIPLPVAALDPEGIVYGALLEVVDQAEDLAKAVNHLSGDLRRAAGSEPIPWDKGQRPGDTLLHALDPIVRRLLAGLRQAGDDFDRCEQGLEAWEHKAGQATLRVAEGLFNSAPAALFTGRRVKKDGKEQVYRLSTAEASFRRRLAVILHRRAAARTAG

SEQ ID NO: 209 - protein, 204 aa, Streptomyces sp. S4
  misc_feature (1)..(204): Cse2
MSTSPLSAPVPGQRVSSLPRPYWSGRADEQGQWRTRAGESLRPPGEDLSALRAGLGKKAFTEPRLWQYYTTPTDGRVTLELEAEHAALALYGLHQQSQEQPMHRQGVRTGRALRALHQRYSEEATDRRVAQAVGATSAAAFAYRLRALVTQLRSIGQPLDYDQLMQDLLRWHFPDGRSRVRRGWGLGYHGRDRQPDEAPPPEGS

SEQ ID NO: 210 - protein, 388 aa, Streptomyces sp. S4
  misc_feature (1)..(388): Cas7
MSQPAARPPRTYVDFHILQTVPPANLNRDDQGNPKEAYYGGVRRSRVSSQAWKRATRTHFAERVPEQDLATRTRRIIGALADDIQKRAGLDRPAALRLADALLAPLELSGGKKKDESAYLLFYGRRQLDAVAALVADQATELSALSDADLASRVKELPVREQFSTGHPIDVALFGRMVADIPALKVDAAAQVAHALSTHAVELEFDYFTAVDDEQTDEETGAGMIGTIGFNSATLYRYASVGLHQLLDNLTDEEAALTAISEFATSFARSMPTGYQNSFAHRTLPSLVAVVVREDQPVNLVSAFEQPVATPSGIAAASAARLAEEHTRATVTWGDAPAFAAATHVFTDHQKTTAALNSAFGPSIPFSALLEGLHTHLAGALKPKQAAQ

SEQ ID NO: 211 - protein, 293 aa, Streptomyces sp. S4
  misc_feature (1)..(293): Cas5
MTTAPTPEPAGNTHPAHGSDEPTVLLLRLAGPLQSWGVRSSFNRRDTGAEPTKSGVIGLLAAAAGHPREQPLGELADLTLGIRVDQPGTLLRDYHTVSDYRGRPLPQAGVSAKGIQKPTSPAKHTHVTTRFYLQDAVFVAALEGPPGLLTTLDRAVRNPAFPLALGRRSCPPTQPLSLGLRTTDMETALRSEPWQASAHTREQYARRLGRERGLHQPLHPGTIDRAATIEDPRGDDRLQDAPVSFDPHQRAFTSRQVRHTWLAIPTGFDHIDDDQPHGQADDPDHDPFALLGW

SEQ ID NO: 212 - protein, 270 aa, Streptomyces sp. S4
  misc_feature (1)..(270): Cas6
MTYLSRIRINPLRKDSRKLLSNPRAVHGAVMGGLPNHKPDDRVLWRMDPDNPHRPHLFVLSPTRPDWTHIIQDCGWPDADGDHAAVRDYTPLLSQLAVGREFAFRLTASPVQNTATPTKATPAQAARLTTHAENGKRIRGFRMGHRTAAAQLDWFLTRTDRWGFDIPATRSDPAAPGIHAPTPPTAPRPTSPPRPDPNPPYEVRITARHRHSFQKNGHGAHVVFRSATFEGRLRITDTDRFTTSLLTGLGPSRAYGCGLLTLAPLPGQQT

SEQ ID NO: 213 - DNA, 90 bp, Streptomyces sp. S4
  misc_feature (1)..(90): CRISPR
gtcggccccgcacccgcggggatgctccaatggccgaggacgacggcgatctggccacggacgtcggccccgcacccgcggggatgctcc

SEQ ID NO: 214 - DNA, 744 bp, Fusobacterium nucleatum subsp. animalis 3_1_33
  misc_feature (1)..(744): Cas6
atggaagtttacgaaatgaaattaaaagtaaaacttaaaaaagatatttttttaaaagatgtttccacatatatcacaagatttatggatatgaatctatcagctaatccaacaatgtacaattatcatacttctaaaatctacaaaggatatacatttgacggactattcccgatagaagaagataaaatatataaaaaagataaaacttattcttttagagtaagaacaataaatcaaaaaatagctaactattttttagatactcttatgttctttgaaaataaagatattcaaggtttgacattaaatataagggtgatagagaaaaaattaattgaaaagttatatacaataactcctattttaatgaaaacagatgagggatattggagatattctatgacttttgaagaatttgaaaaaagattaaaaataaactgtttaaagaagtatttatactttacagagaataatgatgatataactattgatactgaacttttaaaaaaattaggagaagataaatctgatgatatagatttatttactaatattaagtttattaatagaatgcctgtcccaattatttataagggaagaaaattagttggagataaggttgaactacaagttgccaataatgagaaagcacaagatattgcatatatgcttttaggaacagggcttttagaaaattgtgcaaggggttgcggcttcttgaatttcaaaaattatgagtag

SEQ ID NO: 215 - DNA, 1728 bp, Fusobacterium nucleatum subsp. animalis 3_1_33
  misc_feature (1)..(1728): Cas8
ttgattgatgaagcattagaagtatttaaaaaaatttatgataaggagggggaaaaacttgttgtaaacaaacatattccaaaagatggaacatatattttagtaaatataaaatcaggaaaaataatagaaaaattaaatattttctatgataaaaaaagtaaaaaaatagatggtgaacttaatcaatactatggctattttagagcttttgattattattctaatttagtagatatgaataaaccaatggatccaaaaaagacaatacattcaaatcagatttattcattttttataaaaaaagatagcataagagaaaataaattaactaaatcaattattgaaggatataaaaaaaatcttttaaacccagaagaaaaatacaatagtaaggaagggaaagagctatataaaaatatagcagaaaagcttcctaaaattgaaaaagatattgtagaggatatttttttatggatagaagataatgtaaatgaaaatttattagaaaatgacaataaaaaagattacttaaaaatattttttgtagaagaggatttagataaaagtttagaactatttaaaaatgaacataaaagatatattattcctaatatttttaattctaatgattataataaaaaaattggagagactatttatggattgtctaataataatatgggattaaatgcaaaaaaagcatttttggaaaataagacaagaagagtatcaaccccatatttagttaatactgatgaaatacttttacaatatgctttctataattatttattaccagaagtaaaacaaggaaattattttatttatttttcagaaaatgaaattattcctaggacatataaagaaggctgtcctaatggagcaaaatatttattaaatgctagttattcaaaagatgttgatataaaaaattttaatgtaatctcaaaaaatagtagcgaagaaataaatattaattttaaagaaattttacatcaaaagaaaaaagatacagatgagattgaatatggaaatcttaatagagaaaagatgatgaataatataaataaaattcttttctataattctttattaggaaattttttactcagtgatggagatttggatataaaggatattgagataaaaaaactgttaatgaaatatagaaatgctttttataagtggttttatttaaatgatgaagcagaagtcaaaaaaaatattagaaaaatatatctggatgctgtaatggtggcaataggaaatggatatttctttaaagcaagtcaacaacttgattttggcttttgtttggaaaagtatttttatggaaaaagtgagttaatggaggaaattatgaatgtaaaagaagtatttttaaatcatactttatcagaagaagattgggagtttttaaatgatgaagagtattttttcgcagttgggcaaatattagcgtacataaattatatgagaaatagtaaagctaaaagtttgaattttataaaacaactaacttttgttaaaaatattgatgttctaaaagaaaagataaagaaaatagtaatttcatattcacatatttttgaaactaaaaataaaaaaattaatagaacagtatcaaatattagtttgtaccaaccaaaagaaataagaatagatatattattagcaggatttacagcagatataattttctttaaaaagagggaggaaaaataa

SEQ ID NO: 216 - DNA, 948 bp, Fusobacterium nucleatum subsp. animalis 3_1_33
  misc_feature (1)..(948): Cas7
atgaaaatggaaaaaagagtttatggaattttaggaatatcatctattatgtctaattggaatgcagatttcagtggagagcctaagtcaatttctaatggaagaatatttgggagtgataaggcatttaagtatcctatgaaaaaaatgtgggaaaatcaaggagaaaaagttctttatataaaatctttaaaagttgataaaggagctttaattcctaagactttaaaggaaagatatgagcaattatttccagaaaaaaaacttgataaaaatacagaaacaatagaagttattaagaacttatttaaagccatagatgtaaaaaattttggagcaacatttgcagaagaaggaaataatatttctatcacaggggcagttcaaataggacaaggttttaatttctatgatgaaagtaacacagaagttcaagatattctatctccatttagagatccaaaaggaaaaattaataaagaaacaaaagaaaatgaagatgcaaagaactctactttgggaactaaaatagttagtgatgaggcacactatttttatccttttaatataaatcctttggcatataaagaatttatagaattagaaataactgatggatatacagaagaagattatttgaagtttaaagaagcagctttatcatcagcaactttttttgcaacaaattcaaaagttggctgtgataatgaatttggactattcattgaaacagaagaagatttttatttaccaattttaactcaatatataaaatttgaaaagggagaagaaaaaaataaaataactcttaatttaagtactatattaaaaggagtagaaaatcatatcaaaaatatagaaatatactataatccagtaactactgaaattgtaactgatatttctaactataagttgataaatattttaactaagaaagaggtataa

SEQ ID NO: 217 - DNA, 771 bp, Fusobacterium nucleatum subsp. animalis 3_1_33
  misc_feature (1)..(771): Cas5
atggaagcactgaaatttactttaagtggtaatagtgccttttttaaagataatgtaatcaacactgtttatttaacatatggaaatatacatagagtagctttattaggaatgtttggagcaattttaggctatggtggatatagtaaacaaaatgatatgttgaagaaaaaaaataaaaagatgcctgattatccagaattttatgagaaactaaaagatattaaaatatcaatagtttccaacggaaaaaatggttattttaataaaaagttacaaacatttaataatagtgttggttatgcgtcaaaagaagaaggtggaaatttaatagtaaaacaattctggttagaaaatccttcttgggatatttatatattgttagattgtgatgaagcaaagaaaatagcagactatatacagaataggaaagctatttatcttccatatcttggaagcaatgaccatttagcaaatataatggatgtagagataatagatattgaagaaaagatgagttcagaagatgaaactattgaaattctttctatggtaaaagatagtgatatatcagaaaaaaagaaaaatgtatttagtatagataaaaattcaataagagatgatatatataaatattctgaatatttaccagttaccttatcaaaagaattaaatcaatatgaaaaagaaaaaatgacaattactaatatgtctgttatattaaaaaaatcttattataaagtggaagataaaaacattgttttctattaa

SEQ ID NO: 218 - DNA, 744 bp, Fusobacterium nucleatum subsp. animalis 3_1_33
  misc_feature (1)..(744): Cas6
atggaggtgtacgagatgaagctgaaggtgaagctgaagaaggatatctttctgaaggacgtgagcacctatatcacaagattcatggatatgaacctgtccgccaatccaaccatgtacaactatcacacatctaagatctacaagggctatacctttgacggcctgttccccatcgaggaggataagatctacaagaaggacaagacctatagctttcgggtgagaacaatcaaccagaagatcgccaattacttcctggataccctgatgttctttgagaataaggacatccagggcctgacactgaacatcagagtgatcgagaagaagctgatcgagaagctgtacaccatcacacctatcctgatgaagaccgatgagggctactggcggtattctatgacatttgaggagttcgagaagagactgaagatcaactgcctgaagaagtacctgtatttcaccgagaacaatgacgatatcaccatcgacacagagctgctgaagaagctgggcgaggataagagcgacgatatcgacctgtttacaaacatcaagttcatcaataggatgcccgtgcctatcatctacaagggccgcaagctggtgggcgataaggtggagctgcaggtggccaacaatgagaaggcccaggacatcgcctatatgctgctgggaaccggactgctggagaattgcgcacggggctgtggctttctgaacttcaagaattacgagtaa

SEQ ID NO: 219 - DNA, 1728 bp, Fusobacterium nucleatum subsp. animalis 3_1_33
  misc_feature (1)..(1728): Cas8
atgatcgatgaggccctggaggtgtttaagaagatctacgacaaggagggcgagaagctggtggtgaataagcacatccccaaggacggcacatatatcctggtgaatatcaagtctggcaagatcatcgagaagctgaacatcttctacgataagaagagcaagaagatcgacggcgagctgaaccagtactatggctattttcgcgccttcgattactatagcaacctggtggatatgaataagcctatggacccaaagaagaccatccacagcaatcagatctattccttctttatcaagaaggactctatccgggagaacaagctgacaaagagcatcatcgagggctacaagaagaacctgctgaatcctgaggagaagtacaattccaaggagggcaaggagctgtataagaacatcgccgagaagctgccaaagatcgagaaggatatcgtggaggacatcttcctgtggatcgaggacaatgtgaacgagaatctgctggagaacgataataagaaggactatctgaagatcttctttgtggaggaggacctggataagagcctggagctgtttaagaacgagcacaagaggtacatcatccctaacatcttcaactccaacgattacaataagaagatcggcgagaccatctatggcctgtctaacaataacatgggcctgaacgccaagaaggcctttctggagaataagaccaggcgcgtgagcacaccctacctggtgaatacagacgagatcctgctgcagtatgccttctacaactatctgctgcctgaggtgaagcagggcaactactttatctatttctccgagaatgagatcatcccaagaacctacaaggagggctgccccaacggcgccaagtacctgctgaatgcctcttatagcaaggacgtggatatcaagaactttaatgtgatctccaagaatagctccgaggagatcaacatcaatttcaaggagatcctgcaccagaagaagaaggacacagatgagatcgagtacggcaacctgaatagggagaagatgatgaacaacatcaacaagatcctgttttataactccctgctgggcaatttcctgctgtctgacggcgatctggacatcaaggatatcgagatcaagaagctgctgatgaagtaccgcaatgccttttacaagtggttctatctgaacgatgaggccgaggtgaagaagaatatcagaaagatctacctggacgccgtgatggtggccatcggcaacggctatttctttaaggccagccagcagctggactttggcttctgtctggagaagtacttctatggcaagtccgagctgatggaggagatcatgaacgtgaaagaggtgtttctgaatcacaccctgagcgaggaggattgggagttcctgaacgacgaggagtacttctttgccgtgggccagatcctggcctacatcaactatatgcgcaattccaaggccaagagcctgaacttcatcaagcagctgacattcgtgaagaacatcgacgtgctgaaggagaagatcaagaagatcgtgatctcctattctcacatctttgagaccaagaacaagaagatcaataggacagtgtctaacatcagcctgtaccagccaaaggagatccgcatcgatatcctgctggccggcttcaccgccgacatcatcttctttaagaagcgggaggagaagtaa

SEQ ID NO: 220 - DNA, 942 bp, Fusobacterium nucleatum subsp. animalis 3_1_33
  misc_feature (1)..(942): Cas7
atggagaagagagtgtacggcatcctgggcatcagctccatcatgtccaattggaacgccgatttctctggcgagcctaagtctatcagcaatggcagaatctttggctccgacaaggccttcaagtacccaatgaagaagatgtgggagaaccagggcgagaaggtgctgtatatcaagtctctgaaggtggataagggcgccctgatccccaagaccctgaaggagaggtacgagcagctgtttcctgagaagaagctggataagaacaccgagacaatcgaagtgatcaagaatctgttcaaggccatcgacgtgaagaactttggcgccaccttcgccgaggagggcaacaatatcagcatcacaggcgccgtgcagatcggccagggcttcaacttttacgacgagagcaataccgaggtgcaggatatcctgtcccccttcagagaccctaagggcaagatcaacaaggagacaaaggagaacgaggatgccaagaatagcaccctgggcacaaagatcgtgtccgacgaggcccactacttttatccattcaatatcaaccccctggcctacaaggagtttatcgagctggagatcaccgatggctacacagaggaggactatctgaagttcaaggaggccgccctgtctagcgccaccttctttgccacaaactccaaagtgggctgcgataatgagtttggcctgttcatcgagaccgaggaggacttttacctgccaatcctgacacagtatatcaagttcgagaagggcgaggagaagaacaagatcaccctgaatctgtctacaatcctgaagggcgtggagaaccacatcaagaatatcgagatctactataatcccgtgaccacagagatcgtgaccgatatcagcaactacaagctgatcaatatcctgacaaagaaggaagtgtaa

SEQ ID NO: 221 - DNA, 771 bp, Fusobacterium nucleatum subsp. animalis 3_1_33
  misc_feature (1)..(771): Cas5
atggaggccctgaagtttacactgagcggcaattccgccttctttaaggacaacgtgatcaataccgtgtacctgacatatggcaacatccacagggtggccctgctgggcatgtttggcgccatcctgggctacggcggctattctaagcagaacgacatgctgaagaagaagaacaagaagatgccagattaccccgagttctatgagaagctgaaggacatcaagatctctatcgtgagcaacggcaagaatggctactttaataagaagctgcagaccttcaacaatagcgtgggctatgcctccaaggaggagggcggcaatctgatcgtgaagcagttctggctggagaacccctcctgggatatctacatcctgctggactgcgatgaggccaagaagatcgccgactatatccagaaccgcaaggccatctacctgccttatctgggctccaacgatcacctggccaatatcatggatgtggagatcatcgacatcgaggagaagatgtcctctgaggacgagaccatcgagatcctgtctatggtgaaggactccgatatctctgagaagaagaagaacgtgttcagcatcgacaaaaatagcatccgggacgatatctacaagtattctgagtacctgcctgtgacactgagcaaggagctgaatcagtatgagaaggagaagatgaccatcacaaacatgagcgtgatcctgaagaagtcctactataaggtggaggataagaatatcgtgttctactaa

SEQ ID NO: 222 - protein, 247 aa, Fusobacterium nucleatum subsp. animalis 3_1_33
  misc_feature (1)..(247): Cas6
MEVYEMKLKVKLKKDIFLKDVSTYITRFMDMNLSANPTMYNYHTSKIYKGYTFDGLFPIEEDKIYKKDKTYSFRVRTINQKIANYFLDTLMFFENKDIQGLTLNIRVIEKKLIEKLYTITPILMKTDEGYWRYSMTFEEFEKRLKINCLKKYLYFTENNDDITIDTELLKKLGEDKSDDIDLFTNIKFINRMPVPIIYKGRKLVGDKVELQVANNEKAQDIAYMLLGTGLLENCARGCGFLNFKNYE

SEQ ID NO: 223 - protein, 575 aa, Fusobacterium nucleatum subsp. animalis 3_1_33
  misc_feature (1)..(575): Cas8
MIDEALEVFKKIYDKEGEKLVVNKHIPKDGTYILVNIKSGKIIEKLNIFYDKKSKKIDGELNQYYGYFRAFDYYSNLVDMNKPMDPKKTIHSNQIYSFFIKKDSIRENKLTKSIIEGYKKNLLNPEEKYNSKEGKELYKNIAEKLPKIEKDIVEDIFLWIEDNVNENLLENDNKKDYLKIFFVEEDLDKSLELFKNEHKRYIIPNIFNSNDYNKKIGETIYGLSNNNMGLNAKKAFLENKTRRVSTPYLVNTDEILLQYAFYNYLLPEVKQGNYFIYFSENEIIPRTYKEGCPNGAKYLLNASYSKDVDIKNFNVISKNSSEEININFKEILHQKKKDTDEIEYGNLNREKMMNNINKILFYNSLLGNFLLSDGDLDIKDIEIKKLLMKYRNAFYKWFYLNDEAEVKKNIRKIYLDAVMVAIGNGYFFKASQQLDFGFCLEKYFYGKSELMEEIMNVKEVFLNHTLSEEDWEFLNDEEYFFAVGQILAYINYMRNSKAKSLNFIKQLTFVKNIDVLKEKIKKIVISYSHIFETKNKKINRTVSNISLYQPKEIRIDILLAGFTADIIFFKKREEK

SEQ ID NO: 224 - protein, 313 aa, Fusobacterium nucleatum subsp. animalis 3_1_33
  misc_feature (1)..(313): Cas7
MEKRVYGILGISSIMSNWNADFSGEPKSISNGRIFGSDKAFKYPMKKMWENQGEKVLYIKSLKVDKGALIPKTLKERYEQLFPEKKLDKNTETIEVIKNLFKAIDVKNFGATFAEEGNNISITGAVQIGQGFNFYDESNTEVQDILSPFRDPKGKINKETKENEDAKNSTLGTKIVSDEAHYFYPFNINPLAYKEFIELEITDGYTEEDYLKFKEAALSSATFFATNSKVGCDNEFGLFIETEEDFYLPILTQYIKFEKGEEKNKITLNLSTILKGVENHIKNIEIYYNPVTTEIVTDISNYKLINILTKKEV

SEQ ID NO: 225 - protein, 256 aa, Fusobacterium nucleatum subsp. animalis 3_1_33
  misc_feature (1)..(256): Cas5
MEALKFTLSGNSAFFKDNVINTVYLTYGNIHRVALLGMFGAILGYGGYSKQNDMLKKKNKKMPDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDVEIIDIEEKMSSEDETIEILSMVKDSDISEKKKNVFSIDKNSIRDDIYKYSEYLPVTLSKELNQYEKEKMTITNMSVILKKSYYKVEDKNIVFY

SEQ ID NO: 226 - DNA, 96 bp, Fusobacterium nucleatum subsp. animalis 3_1_33
  misc_feature (1)..(96): CRISPR
atgaactgtaaacttgaaaagttttgaaatgttgacaaatattcagataatttttcaaaatcttttatgaactgtaaacttgaaaagttttgaaat

SEQ ID NO: 227 - DNA, 723 bp, Campylobacter fetus subsp. testudinum Sp3
  misc_feature (1)..(723): Cas6
atggatgtgaaaatatatcagctgaaagtatttttaaagttaaatcaaaatgtagattttataaatagccctgagtttttaagcacaaatttacataaagctatgttgggggatgaagctctacgatctattcatatgcaaagatatttaaagccttatagcatcggttttttatacagtatgaaaggcaaaaaagatacttttgtgagtggtgaagatatgtatttttacgtaagaagtattgatgagagttttatatctaagttaagaatttgtttagaaaattctaaaaatcttgggtttaatgtatatttatctaaatttgaaaatttggatataaagcaagtcgatcgtttatatactatgagtccggcaactatcgtgcttaaagaaggcgataaaactataccttggagacgtgaaaatagcgatataacagtgcttaaagaagctttgatttcaaatttaaaaaacaaatacgaatattttttagacaaaaaaattgagataaaagatgatatcatcgaacttatagagataaaaacaaatagagcgtttgcatttagatataaaaacggtaaaatttatgcttatagatatcaaattcacttttcccaaaacagattggctcaagagtttgcaaatatcgccatgatacttggtgttggagttaaaaatacattgggatttggcttttgtatgaggagtaataatgctgtttga

SEQ ID NO: 228 - DNA, 1692 bp, Campylobacter fetus subsp. testudinum Sp3
  misc_feature (1)..(1692): Cas8
atgctgtttgaattgcttgatgagtttaaaaaacagcttgaaaaaaataagcacatagtcacacaaaatcacattttaaaagacggagtttatgcgagaatttccgatgaaaaatgtgagattttttacgtaaaaactatcacagaaaaaataggtaaaactgcgcagaaaagaacgattttatacaaacaaaacggagatatcgcgttaaatgatgatatgcagtggtttgagcaagctgattatttaagtttcttatgggatatgaataaagctgttttgcctaataaaaaatttcacagcattaactttttgtctctattttttaagcttgaagagtctgagtatgttaaggaaaatttggaagagtattttgatatttttagagattatagtgcatttaataaagcaaaagataaggaaattttatcattttatatggattatataaaagatgaaaatagacaaaacttgatcacaaattcagtagttttatctaaaaaatattttaatgatataaatgattttgctgtacaaaataactttaaaaagtgttatattaagttttttattgacaaagattttgagatttatgaaaaagagtcgcaaatttatattgatttgaaaatttacaattcaaatgaacacaatataaaatataataatgaaattttcggtctttcaaatttcaatatgggtatgaattcaaaaaaaccttttttagagcataaaaatagattatttaaaataccttacgccataagtcaaaaagacgctcttgctagtaaaatgctttttgattggcttggttcgcaaaataaaagaattattcgtgattttaactcaatctttatatctaaattcaataaacaatcaaaagccgtggtaagtgacttcgagtatgttcctgtagataaaaataagtttaaatttgataaatttaaacttaaaaattttatgaatattgaaaatggtgaaaaagagatacttagttttgatgattttaagcaagttattgatgagcagctttatcataaatgtctttttggtaatttgtataatgatgagataagagttagtaaaagaatcagcgaagatatgcaaaatttactttatcaaactagatgttctatggtggagtattttgataaatttaataacaatgaattttactatgttatacaaaaatattctaatgattttattaaaattgctatgcaagatagtgaatttggtagattaaacggtaaaaaatctataaatttgctacttagtataaaagaaattaaaggagaaaaagtggatatagacgggataaaaaatagagttatatcagcacttactgatgataatgtaactaaattaagcggaaatgaatactactttttagtaggtaatttagcaatgtatctagttagtaaaagcaagacttggaaaaagacgtttgcactaactgacccatacactaaagctagaaatacaaaaaagctaaaaatggctctgtttattgattttgatagatacaactatgatatttttttagaaaatggaatattaaaaaaagcattttcattggctcaaaattgtgaagatatagttatgtcaaataacgaccaacagatggttttaatcggtatgatgacaaaaaatataattaagaaaccaggagaaaaagatgaaattagcgaatag

SEQ ID NO: 229 - DNA, 942 bp, Campylobacter fetus subsp. testudinum Sp3
  misc_feature (1)..(942): Cas7
atgaaattagcgaatagaatttatggaataatcggtataaaatcaactatggccaactggaatgcagattttagcggcagaccaaaaagcacaggaaacggagatatctttgctagtgataaagctttaaaatatcctatgaaaaagatgtgggaaagctatggaaaaaatattctttttgtaaaatctctaaaacaaggcaagagtaaggatggcaatgacaagctcgtgccaaatactctaggagaaagatatggtttgctttttggcgatatcaaaaaagcaaaatccacaaaagaggttttgagtaacctttttaactgcattgatgttaaaaatttcggtgctacattccctgaagatggttataacttatcaataactggtgcagttcagataggacaaggatttaataaatttggagatataaatatagaagttcaaaatatcttatctccatttgccgattcaagagctaaagagaaaaacgaaaatggagaagatgcgagccaaagcactctgggtacaaaaatagttacagatgaggctcattatttttacggattttgcataaatccgttagcttataatgattataaagagattttgggtgatgattttggttacaatgaagatgattacgctgagttcaaaaaggctgctagattttgcgctacgtattttaattccaactcaaaattcggctgcgaaaatgagtttgctatgttcattgaaacagccgtagatgcatatctgcctgatcttagttcatatatggattttatttgcaaagataaaaatagattggtaaatttagaaaaaatagaaaaaatgatagaaagttcagatgtaaaaaaagtagaaatttattacaatcctttatctttggacgtagaaactaaatttgataaattcgatatttacagtggaaataaaatatga

SEQ ID NO: 230 - DNA, 762 bp, Campylobacter fetus subsp. testudinum Sp3
  misc_feature (1)..(762): Cas5
atgaaagccataagttttaagcttagcggaaagtttgcacatttcaaaaaaccagatgtaaatgaatatgtgtattttacttataataatatcccaaaaccaactctattagggcttttgggggccattatagggcttaaaggatacgcgcaaaaaacttataataataaaaaagataaaaaatcacttttaaacaatgaaaacagaagtaacgagccggaattttatgagcgtttaaaacatcttaaaatttgtattattcctcttgttaaatatggtaaattttctaaaaaaattcaagttttcaataattcagtaggatacgcaagcaccgaagaaggtggaaatttaatagttagagagcaatggcttgaaaatccttcttggcagatacttatagaagatgacggaagtgcggagtttgagactatttcacaatatctatttgataaaaaagctaagtttataccatatcttggtaaaaatgaccattttgcagatataagcgaagtggagaaaatagatcttgcagagtctaaaaaagataaaattgtgataaaatcgctgtttttggataatttagcaaagcaggttgatgaccctgatgatgagatatcatatctttttaatgaattttatcctattggttttaatgaacttatgttttataagcttgaaaaaactacttttacaaatcaaatttgtcaagcaatggacgggaaatggtatgagtttaaagacggaactatatgcttcttttaa

SEQ ID NO: 231 - DNA, 723 bp, Campylobacter fetus subsp. testudinum Sp3
  misc_feature (1)..(723): Cas6
atggatgtgaagatctaccagctgaaggtgttcctgaagctgaatcagaacgtggacttcatcaacagcccagagtttctgtccaccaatctgcacaaggccatgctgggcgatgaggccctgaggtccatccacatgcagcggtacctgaagccctactctatcggctttctgtacagcatgaagggcaagaaggacacatttgtgagcggcgaggatatgtacttctatgtgcggtccatcgacgagtctttcatcagcaagctgagaatctgcctggagaattctaagaacctgggctttaacgtgtatctgagcaagttcgagaatctggacatcaagcaggtggataggctgtacaccatgagccctgccacaatcgtgctgaaggagggcgataagaccatcccatggcggagagagaactccgacatcacagtgctgaaggaggccctgatctctaatctgaagaacaagtacgagtatttcctggacaagaagatcgagatcaaggacgatatcatcgagctgatcgagatcaagaccaatcgggccttcgcctttagatataagaacggcaagatctacgcctataggtaccagatccactttagccagaaccgcctggcccaggagttcgccaatatcgccatgatcctgggcgtgggcgtgaagaataccctgggcttcggcttttgcatgaggtccaacaatgcagtgtaa

SEQ ID NO: 232 - DNA, 1692 bp, Campylobacter fetus subsp. testudinum Sp3
  misc_feature (1)..(1692): Cas8
atgctgttcgagctgctggatgagtttaagaagcagctggagaagaacaagcacatcgtgacacagaatcacatcctgaaggatggcgtgtatgcccgcatctccgacgagaagtgtgagatcttctacgtgaagaccatcacagagaagatcggcaagaccgcccagaagcggacaatcctgtataagcagaacggcgacatcgccctgaatgacgatatgcagtggtttgagcaggccgactacctgagcttcctgtgggatatgaacaaggccgtgctgcccaataagaagttccacagcatcaactttctgtccctgttctttaagctggaggagtccgagtacgtgaaggagaatctggaggagtattttgacatcttcagagattactccgcctttaacaaggccaaggataaggagatcctgtctttctatatggactacatcaaggatgagaataggcagaacctgatcaccaattctgtggtgctgagcaagaagtacttcaatgacatcaacgattttgccgtgcagaacaatttcaagaagtgctacatcaagttctttatcgacaaggatttcgagatctacgagaaggagagccagatctatatcgacctgaagatctacaattccaacgagcacaacatcaagtataacaatgagatcttcggcctgtctaacttcaacatgggcatgaatagcaagaagccatttctggagcacaagaaccgcctgttcaagatcccctacgccatctcccagaaggatgccctggcctctaagatgctgtttgactggctgggcagccagaacaagcggatcatcagagactttaattccatcttcatctctaagtttaacaagcagtctaaggccgtggtgagcgacttcgagtacgtgcccgtggataagaacaagtttaagttcgacaagttcaagctgaagaacttcatgaacatcgagaatggcgagaaggagatcctgagctttgacgatttcaagcaggtcatcgatgagcagctgtatcacaagtgcctgtttggcaacctgtacaatgatgagatcagggtgagcaagcgcatctccgaggacatgcagaatctgctgtatcagacccggtgttccatggtggagtactttgacaagttcaacaataacgagttctactatgtgatccagaagtactctaacgacttcatcaagatcgccatgcaggacagcgagttcggccgcctgaacggcaagaagagcatcaatctgctgctgtccatcaaggagatcaagggcgagaaggtggacatcgatggcatcaagaatagagtgatctccgccctgaccgacgataacgtgacaaagctgtctggcaatgagtactattttctggtgggcaacctggccatgtacctggtgagcaagtccaagacctggaagaagacattcgccctgaccgatccatatacaaaggcccggaacaccaagaagctgaagatggccctgtttatcgacttcgatagatataactacgacatctttctggagaatggcatcctgaagaaggccttcagcctggcccagaattgtgaggatatcgtgatgtccaataacgaccagcagatggtgctgatcggcatgatgacaaagaacatcatcaagaagcccggcgagaaggacgagatcagcgagtaa

SEQ ID NO: 233 - DNA, 942 bp, Campylobacter fetus subsp. testudinum Sp3
  misc_feature (1)..(942): Cas7
atgaagctggccaaccgcatctacggcatcatcggcatcaagagcaccatggccaattggaacgccgacttttctggccgccccaagagcacaggcaatggcgacatcttcgccagcgataaggccctgaagtatcctatgaagaagatgtgggagtcctacggcaagaacatcctgttcgtgaagtccctgaagcagggcaagtctaaggacggcaacgataagctggtgccaaataccctgggcgagcggtatggcctgctgtttggcgatatcaagaaggccaagagcacaaaggaggtgctgtccaatctgttcaactgcatcgatgtgaagaattttggcgccaccttcccagaggacggctacaacctgagcatcacaggcgccgtgcagatcggccagggctttaacaagttcggcgacatcaacatcgaggtgcagaatatcctgtcccccttcgccgatagccgggccaaggagaagaatgagaacggagaggacgcctcccagtctaccctgggcacaaagatcgtgaccgatgaggcccactacttttatggcttctgtatcaaccccctggcctataatgactacaaggagatcctgggcgacgattttggctataatgaggacgattacgccgagttcaagaaggccgccagattctgcgccacctactttaatagcaactccaagtttggctgtgagaacgagtttgccatgttcatcgagacagccgtggacgcctatctgcctgatctgagctcctacatggacttcatctgcaaggataagaacaggctggtgaatctggagaagatcgagaagatgatcgagtctagcgatgtgaagaaggtggagatctactataatcctctgtccctggacgtggagaccaagtttgacaagttcgatatctattctggcaacaagatctaa

SEQ ID NO: 234 - DNA, 762 bp, Campylobacter fetus subsp. testudinum Sp3
  misc_feature (1)..(762): Cas5
atgaaggccatcagctttaagctgtccggcaagtttgcccacttcaagaagccagacgtgaacgagtacgtgtacttcacctacaacaatatccccaagcctacactgctgggactgctgggagcaatcatcggcctgaagggctatgcccagaagacctacaacaataagaaggacaagaagagcctgctgaacaatgagaatcggtccaacgagcctgagttctatgagagactgaagcacctgaagatctgcatcatcccactggtgaagtacggcaagttttctaagaagatccaggtgttcaacaattctgtgggatatgccagcaccgaggagggaggaaatctgatcgtgagggagcagtggctggagaaccccagctggcagatcctgatcgaggacgatggctctgccgagtttgagacaatcagccagtatctgttcgataagaaggccaagtttatcccttacctgggcaagaatgaccacttcgccgatatctccgaggtggagaagatcgacctggccgagtccaagaaggataagatcgtgatcaagtctctgttcctggacaacctggccaagcaggtggacgatcccgacgatgagatctcttatctgtttaacgagttctaccctatcggcttcaatgagctgatgttttacaagctggagaagaccaccttcaccaatcagatctgtcaggccatggatggcaagtggtatgagttcaaggacggcaccatctgcttcttttaa

SEQ ID NO: 235 - protein, 240 aa, Campylobacter fetus subsp. testudinum Sp3
  misc_feature (1)..(240): Cas6
MDVKIYQLKVFLKLNQNVDFINSPEFLSTNLHKAMLGDEALRSIHMQRYLKPYSIGFLYSMKGKKDTFVSGEDMYFYVRSIDESFISKLRICLENSKNLGFNVYLSKFENLDIKQVDRLYTMSPATIVLKEGDKTIPWRRENSDITVLKEALISNLKNKYEYFLDKKIEIKDDIIELIEIKTNRAFAFRYKNGKIYAYRYQIHFSQNRLAQEFANIAMILGVGVKNTLGFGFCMRSNNAV

SEQ ID NO: 236 - protein, 563 aa, Campylobacter fetus subsp. testudinum Sp3
  misc_feature (1)..(563): Cas8
MLFELLDEFKKQLEKNKHIVTQNHILKDGVYARISDEKCEIFYVKTITEKIGKTAQKRTILYKQNGDIALNDDMQWFEQADYLSFLWDMNKAVLPNKKFHSINFLSLFFKLEESEYVKENLEEYFDIFRDYSAFNKAKDKEILSFYMDYIKDENRQNLITNSVVLSKKYFNDINDFAVQNNFKKCYIKFFIDKDFEIYEKESQIYIDLKIYNSNEHNIKYNNEIFGLSNFNMGMNSKKPFLEHKNRLFKIPYAISQKDALASKMLFDWLGSQNKRIIRDFNSIFISKFNKQSKAVVSDFEYVPVDKNKFKFDKFKLKNFMNIENGEKEILSFDDFKQVIDEQLYHKCLFGNLYNDEIRVSKRISEDMQNLLYQTRCSMVEYFDKFNNNEFYYVIQKYSNDFIKIAMQDSEFGRLNGKKSINLLLSIKEIKGEKVDIDGIKNRVISALTDDNVTKLSGNEYYFLVGNLAMYLVSKSKTWKKTFALTDPYTKARNTKKLKMALFIDFDRYNYDIFLENGILKKAFSLAQNCEDIVMSNNDQQMVLIGMMTKNIIKKPGEKDEISE

SEQ ID NO: 237 - protein, 313 aa, Campylobacter fetus subsp. testudinum Sp3
  misc_feature (1)..(313): Cas7
MKLANRIYGIIGIKSTMANWNADFSGRPKSTGNGDIFASDKALKYPMKKMWESYGKNILFVKSLKQGKSKDGNDKLVPNTLGERYGLLFGDIKKAKSTKEVLSNLFNCIDVKNFGATFPEDGYNLSITGAVQIGQGFNKFGDINIEVQNILSPFADSRAKEKNENGEDASQSTLGTKIVTDEAHYFYGFCINPLAYNDYKEILGDDFGYNEDDYAEFKKAARFCATYFNSNSKFGCENEFAMFIETAVDAYLPDLSSYMDFICKDKNRLVNLEKIEKMIESSDVKKVEIYYNPLSLDVETKFDKFDIYSGNKI

SEQ ID NO: 238 - protein, 253 aa, Campylobacter fetus subsp. testudinum Sp3
  misc_feature (1)..(253): Cas5
MKAISFKLSGKFAHFKKPDVNEYVYFTYNNIPKPTLLGLLGAIIGLKGYAQKTYNNKKDKKSLLNNENRSNEPEFYERLKHLKICIIPLVKYGKFSKKIQVFNNSVGYASTEEGGNLIVREQWLENPSWQILIEDDGSAEFETISQYLFDKKAKFIPYLGKNDHFADISEVEKIDLAESKKDKIVIKSLFLDNLAKQVDDPDDEISYLFNEFYPIGFNELMFYKLEKTTFTNQICQAMDGKWYEFKDGTICFF

SEQ ID NO: 239 - DNA, 95 bp, Campylobacter fetus subsp. testudinum Sp3
  misc_feature (1)..(95): CRISPR
gtttgctaatgacaatatttgtgttaaaacaagcgtagcaccaaaagaagcgtatgaaagcataggtttgctaatgacaatatttgtgttaaaac

SEQ ID NO: 240 - DNA, 771 bp, Odoribacter splanchnicus DSM 20712
  misc_feature (1)..(771): Cas6
atgcgtttgaaattggtacttaaaattgtggaaggaaccgttttaccttgtaattatatgtatgaattgtcaagttgtttgtacaaggtattgaatgaaggtaatccggtttttactgcctggctacatgataaaggatattgtaaggaaaagaaagcatttaaattatttaccttttcgaatttctattttccgtgtttcagaatcgagggggatcggatttttgttttggcggatacggcccagttgattgtgtcgttctatccgatagaagcaattgatgcttttgtaatgggtctgtttaagaacaggcaattggaggttggtgaccggaaatcgagggtccgctttgaagtctttaacttagagcggcaggctgagccggaattcacttcccggatgttttttaaaactctatcgcctatgtttattgaagagcaattaccggaaacccggaaagcgatacatctttcaccggggaatccgaagtttgcagaattgttgcatttgaatctgctggataaatacagggtgttttatggacaggaacccgatccgtcctggcctctgacccgcttgcatttgttgtctgagcccaagcctaaaacaattgtgctgaaggtaggtactccggaggaaaccagaatgaaaggatatactttccgctttgagctggaaggacagccggaattattgcgtctgggttacgaaggtggtttcggacgattgaacagccagggattcggttgtgtggaagtgttgaaacagtga

SEQ ID NO: 241 - DNA, 1845 bp, Odoribacter splanchnicus DSM 20712
  misc_feature (1)..(1845): Cas8
atgcttcaggaaattaataactttatgaatagtttgcctgctgagttaaagcaggcggggctgaagcctaaagaaggactgcatgttttgctgaaaatccaggaaaaggagggaactcattttatggacgaacagtctgtctgccgggtttgtctgacccggaaagcgacagaattcgattatccttttttacagcattgtgctgagctggctcaggtgggatggtgtgtgaataccaataaatgtttcgatcttccggctaaggggctgcattcctgttctccttattgcattgccttgaaacgggaatctctggaaggaggaggaaaatatgcgaaagataagactaaaatctacgaccgtatcgatacttattttgctaatgctttatcctacgtcgaagaggatagcgagaaagaaagaataagggtttttcagcattttatcaactccaaagagaaactgaatgctttatttgcctgttttcagtcagaggttgatgaagtcaaggataaggagtacattattctttatttggaggaggagatggaaaaatatcgccgggttcatgaaaaatatttgtcggacaaattattcaataccaatgaatacaatatttcggtagaaaatcaactctatgggaccagcgatttcctgaatggatttccaactaaaaagccttttttatcccatcagtcggctgttttcgatattgccgggcggattaccggagagatggctggaaatctccatgattttcaggaaatcatgcgccggaatgttttaccccgtcctttgccgttgtttgtttaccgggaagagttgcagaccgaaatgcttgcggttttctcccggtatttggcggatggcaagaggatcggttatcaggagatcatacgggagctttataaaaatcatcaggacgatatcggtgattattatttattgtattactatggcgatacggtttgtgatttcgattttgtttcccgtttccgctatcgtttgcagagtggggataaagaaggttggatggtaaaagatcattttcagatcggttttacggagaaaataagccatgtatttgagttggaggaaaaagtgttacgcgaaatatttaataactcgttgattacacgaacgaaagccggagatacacaacgtaaatatttcgatgaattagaaccgaaatactgtaaatcggaaaataactatttattggtattgaagtatcggcaagctttttatgattatatctataaatccagattacaggctgttacccgtcctatgttcgatcatattttattgaccggtattttggaggatatccgtttggatgaattaaaaggaaaccagcatacccaacgctgggggattttgtctaaaatgaacatttggttcagtttggctgaacgttttgatttacaatttaaaaatacagatactatggcaagtaaattggaagaacagagagtgtttatggttgccttatcgcaaggtgaggctatattggaaaacgacgaacaatatgcttttgcagccggacaggtgatttactatttattacataagagtaagacggcagacaaaagttataaacggctggagccttttttgcagcaggtgcacgcctctgaattgaataaagcgattgcccggcttttcgatacctataagcatgagaatttttcaggcaatttccgtcatccgtttgcatcggttatggcctatcagacccaagcgaatatgcgggactacctgcccatgatgctggccgggattttttcggataatctgctttttagcgttaataaatcagaagaaacaaatgaagaaaactaa

SEQ ID NO: 242 - DNA, 939 bp, Odoribacter splanchnicus DSM 20712
  misc_feature (1)..(939): Cas7
atgagtaatacatttaaaaacagagtgtttggttgtgtggtaatcaaatctgtcaattccaattataatgcggacttttcacatcagccccgtactttgcccgatgggtcggtatatgcaacagataaagcattgaaatataccgttcggaattatatagataaaaattatccggaagacaaggtattttattttaaaagcctgaatggagatatgcagccccgggatttagaccagaattatgcccgtttcttcggcgattatccgaaagcggataagaaagaggcggtcaaggcgcgtaaagtgattctgggaaatttgttgagctgtctggatgtacggttatttggcggaacttttgccagtaaaacggccaatttgtctattcatggtgttgtacaaccgacgcatggggtgaaccgatatgtggaagggattatctattcagagcagattgcttcgcctttccggaactccaatgataatagtacggattcgatgcaaacgactttaggaacccaatttaaattacaggaaggccattacgtacatcatttttcagtcaatcccggtaatttagacgaactgactgaatttgtcgataatggaagattaacgggggaggatattgccaaattgaaagaagctttacgttgcggagtgacatattatgattcctcttccaaggcaggaacggagaatgaggccttgttgtgggtggaattgaaagaagagtcgaagctggtattaccctctttcgtggatttgatagaggtaaatgcagaacgggaaattgattttgcgaaagtgagtaccttattgtccaaagaaaaaatcaaaaatgagatctcaaaaattgaattgttttacaataagggaattacaaaagtgattcatctgccggaaggaacggtcgaacttgaattgaacgggttatga

SEQ ID NO: 243 - DNA, 780 bp, Odoribacter splanchnicus DSM 20712
  misc_feature (1)..(780): Cas5
atgaataatcaacgactgatttcatttgatatacaggctgatttcggtttcttcaaaaagcccgattacaatgatggggtgttgctgacctataatatgttacataagcccgccctgttaggcatattgggggctattatcggtttgcggggttatcggaaaaaaggagaatggccggaatattaccagcggttggctgccctcccggtgggaatagaacctttggaggggagacatgagaaagggaattttcagaaaacgatagtcaagtatacgaatacggtcggatatgctaatcaggatggtaacctgctggttgaagagagtatgctgattcgtccggcctatcgctgctatcttttgttgtcggaagagcatccggatcaccggaagttgtacgagtatatccgggaaggatgggccgagtatattccctatttgggtaaaaatgaatatccggcctggttcggagattcgttccgggaatatgcttttaaaacttttgtaccggaaactgatttccgggtttcatccttgtttatcaaagaaggagtattgaaaggacagcaggtaaaggccagtttttcgttttcgctgaaaggcatagtgaatcgaggtagttttgtgtatttcgaacgtttgcctgttggttttcatccggttctgatgcaatatgaattggccgacttcgcttttacggattggaccttacaggctgccacgcagatggtaaatttgtatcagctggaagaggaaggaaagattgttcaattgttttga

SEQ ID NO: 244 - DNA, 771 bp, Odoribacter splanchnicus DSM 20712
  misc_feature (1)..(771): Cas6
atgaggctgaagctggtgctgaagatcgtggagggcacagtgctgccctgcaactatatgtacgagctgagctcctgtctgtacaaggtgctgaacgagggcaatcccgtgttcaccgcctggctgcacgataagggctattgcaaggagaagaaggcctttaagctgttcacattttccaatttctactttccatgtttcagaatcgagggcgacaggatctttgtgctggccgataccgcccagctgatcgtgtctttctaccccatcgaggccatcgacgccttcgtgatgggcctgtttaagaaccgccagctggaagtgggcgatcggaagtccagggtgcgctttgaggtgttcaatctggagaggcaggcagagcctgagttcaccagccggatgttctttaagacactgtccccaatgtttatcgaggagcagctgcccgagacaagaaaggccatccacctgtctcctggcaacccaaagttcgccgagctgctgcacctgaatctgctggacaagtacagagtgttttatggccaggagcccgatcctagctggccactgaccaggctgcacctgctgtccgagccaaagcccaagacaatcgtgctgaaggtcggcacccccgaggagacaagaatgaagggctataccttcaggtttgagctggagggccagcctgagctgctgagactgggatacgagggaggattcggcaggctgaacagccagggctttggctgcgtggaggtgctgaagcagtaa

SEQ ID NO: 245 - DNA, 1845 bp, Odoribacter splanchnicus DSM 20712
  misc_feature (1)..(1845): Cas8
atgctgcaggagatcaacaatttcatgaattctctgccagcagagctgaagcaggcaggcctgaagccaaaggagggactgcacgtgctgctgaagatccaggagaaggagggcacccactttatggacgagcagtccgtgtgccgggtgtgcctgacccggaaggcaacagagtttgattaccccttcctgcagcactgcgcagagctggcccaagtgggatggtgcgtgaacacaaataagtgtttcgacctgcctgccaagggcctgcactcttgcagcccatattgtatcgccctgaagagagagagcctggagggaggcggcaagtacgcaaaggacaagaccaagatctatgacaggatcgatacatactttgccaacgccctgagctacgtggaggaggattccgagaaggagcggatcagagtgtttcagcacttcatcaactccaaggagaagctgaatgccctgtttgcctgtttccagtctgaggtggacgaggtgaaggataaggagtacatcatcctgtatctggaggaggagatggagaagtataggcgcgtgcacgagaagtacctgtccgacaagctgttcaacaccaatgagtataacatcagcgtggagaatcagctgtacggcacctccgattttctgaacggcttcccaacaaagaagcccttcctgagccaccagtccgccgtgtttgacatcgcaggaaggatcaccggagagatggcaggcaacctgcacgattttcaggagatcatgcggagaaatgtgctgcctcgcccactgcccctgttcgtgtatcgggaggagctgcagacagagatgctggccgtgtttagcagatacctggccgacggcaagaggatcggctatcaggagatcatccgcgagctgtacaagaaccaccaggacgatatcggcgactactatctgctgtactattacggcgataccgtgtgcgactttgatttcgtgtctaggttccgctacaggctgcagagcggcgacaaggagggatggatggtgaaggatcactttcagatcggcttcaccgagaagatcagccacgtgttcgagctggaggagaaggtgctgcgggagatctttaacaattccctgatcaccagaacaaaggccggcgacacacagaggaagtatttcgatgagctggagcccaagtactgtaagtctgagaacaattatctgctggtgctgaagtacagacaggccttctatgactacatctataagagccgcctgcaggcagtgacccggcctatgtttgatcacatcctgctgacaggcatcctggaggacatcagactggatgagctgaagggcaaccagcacacccagaggtggggcatcctgtccaagatgaatatctggttctctctggccgagcggttcgacctgcagttcaagaacaccgatacaatggccagcaagctggaggagcagcgggtgttcatggtggccctgtcccagggagaggcaatcctggagaatgacgagcagtacgcctttgccgccggccaggtcatctactacctgctgcacaagtctaagaccgccgataagagctataagaggctggagcccttcctgcagcaggtgcacgcctccgagctgaacaaggccatcgcccgcctgtttgacacctacaagcacgagaacttttctggcaatttccggcacccatttgccagcgtgatggcctatcagacacaggccaatatgcgcgactacctgcccatgatgctggccggcatcttcagcgataacctgctgttttccgtgaataagtctgaggagaccaacgaggagaattaa

SEQ ID NO: 246 - DNA, 939 bp, Odoribacter splanchnicus DSM 20712
  misc_feature (1)..(939): Cas7
atgtctaacaccttcaagaatcgggtgtttggctgcgtggtcatcaagagcgtgaactccaattataacgccgacttctcccaccagccacgcacactgcctgacggcagcgtgtacgccaccgataaggccctgaagtacacagtgcggaactatatcgacaagaattaccctgaggataaggtgttctactttaagtctctgaacggcgacatgcagccacgcgacctggatcagaattatgcccggttctttggcgactaccccaaggccgataagaaggaggccgtgaaggccagaaaagtgatcctgggcaacctgctgagctgtctggatgtgaggctgtttggcggcaccttcgcctctaagacagccaacctgagcatccacggagtggtgcagcctacccacggagtgaatagatatgtggagggcatcatctacagcgagcagatcgcctccccattcaggaattctaacgacaattctaccgatagcatgcagaccacactgggcacacagttcaagctgcaggagggccactacgtgcaccactttagcgtgaacccaggcaatctggacgagctgaccgagtttgtggataacggccgcctgacaggcgaggacatcgcaaagctgaaggaggccctgagatgcggagtgacctactatgatagctcctctaaggccggcacagagaacgaggccctgctgtgggtggagctgaaggaggagtccaagctggtgctgccctctttcgtggacctgatcgaagtgaatgccgagcgggagatcgattttgccaaggtgtctaccctgctgagcaaggagaagatcaagaacgagatctccaagatcgagctgttctacaataagggcatcaccaaagtgatccacctgcctgagggcacagtggagctggagctgaacggactgtaa

SEQ ID NO: 247 - DNA, 780 bp, Odoribacter splanchnicus DSM 20712
  misc_feature (1)..(780): Cas5
atgaacaatcagcggctgatctctttcgacatccaggccgattttggcttctttaagaagcctgactataacgatggcgtgctgctgacctacaatatgctgcacaagccagccctgctgggcatcctgggagccatcatcggcctgagaggctacaggaagaagggcgagtggcccgagtactatcagagactggccgccctgcctgtgggaatcgagccactggagggcaggcacgagaagggcaacttccagaagacaatcgtgaagtataccaatacagtgggctacgccaaccaggacggcaatctgctggtggaggagtctatgctgatccgccctgcctaccggtgctatctgctgctgagcgaggagcacccagatcaccgcaagctgtatgagtacatccgggagggctgggccgagtacatcccttatctgggcaagaacgagtatccagcctggtttggcgactccttccgcgagtacgcctttaagaccttcgtgcctgagacagatttccgggtgtctagcctgtttatcaaggagggcgtgctgaagggccagcaggtgaaggcctccttctcttttagcctgaagggcatcgtgaatagaggcagcttcgtgtacttcgagaggctgcccgtgggcttccaccctgtgctgatgcagtacgagctggccgacttcgcctttaccgattggacactgcaggccgccacccagatggtgaacctgtaccagctggaggaggagggcaagatcgtgcagctgttttaa

SEQ ID NO: 248 - protein, 256 aa, Odoribacter splanchnicus DSM 20712
  misc_feature (1)..(256): Cas6
MRLKLVLKIVEGTVLPCNYMYELSSCLYKVLNEGNPVFTAWLHDKGYCKEKKAFKLFTFSNFYFPCFRIEGDRIFVLADTAQLIVSFYPIEAIDAFVMGLFKNRQLEVGDRKSRVRFEVFNLERQAEPEFTSRMFFKTLSPMFIEEQLPETRKAIHLSPGNPKFAELLHLNLLDKYRVFYGQEPDPSWPLTRLHLLSEPKPKTIVLKVGTPEETRMKGYTFRFELEGQPELLRLGYEGGFGRLNSQGFGCVEVLKQ

SEQ ID NO: 249 - protein, 614 aa, Odoribacter splanchnicus DSM 20712
  misc_feature (1)..(614): Cas8
MLQEINNFMNSLPAELKQAGLKPKEGLHVLLKIQEKEGTHFMDEQSVCRVCLTRKATEFDYPFLQHCAELAQVGWCVNTNKCFDLPAKGLHSCSPYCIALKRESLEGGGKYAKDKTKIYDRIDTYFANALSYVEEDSEKERIRVFQHFINSKEKLNALFACFQSEVDEVKDKEYIILYLEEEMEKYRRVHEKYLSDKLFNTNEYNISVENQLYGTSDFLNGFPTKKPFLSHQSAVFDIAGRITGEMAGNLHDFQEIMRRNVLPRPLPLFVYREELQTEMLAVFSRYLADGKRIGYQEIIRELYKNHQDDIGDYYLLYYYGDTVCDFDFVSRFRYRLQSGDKEGWMVKDHFQIGFTEKISHVFELEEKVLREIFNNSLITRTKAGDTQRKYFDELEPKYCKSENNYLLVLKYRQAFYDYIYKSRLQAVTRPMFDHILLTGILEDIRLDELKGNQHTQRWGILSKMNIWFSLAERFDLQFKNTDTMASKLEEQRVFMVALSQGEAILENDEQYAFAAGQVIYYLLHKSKTADKSYKRLEPFLQQVHASELNKAIARLFDTYKHENFSGNFRHPFASVMAYQTQANMRDYLPMMLAGIFSDNLLFSVNKSEETNEEN

SEQ ID NO: 250 - protein, 312 aa, Odoribacter splanchnicus DSM 20712
  misc_feature (1)..(312): Cas7
MSNTFKNRVFGCVVIKSVNSNYNADFSHQPRTLPDGSVYATDKALKYTVRNYIDKNYPEDKVFYFKSLNGDMQPRDLDQNYARFFGDYPKADKKEAVKARKVILGNLLSCLDVRLFGGTFASKTANLSIHGVVQPTHGVNRYVEGIIYSEQIASPFRNSNDNSTDSMQTTLGTQFKLQEGHYVHHFSVNPGNLDELTEFVDNGRLTGEDIAKLKEALRCGVTYYDSSSKAGTENEALLWVELKEESKLVLPSFVDLIEVNAEREIDFAKVSTLLSKEKIKNEISKIELFYNKGITKVIHLPEGTVELELNGL

SEQ ID NO: 251 - protein, 259 aa, Odoribacter splanchnicus DSM 20712
  misc_feature (1)..(259): Cas5
MNNQRLISFDIQADFGFFKKPDYNDGVLLTYNMLHKPALLGILGAIIGLRGYRKKGEWPEYYQRLAALPVGIEPLEGRHEKGNFQKTIVKYTNTVGYANQDGNLLVEESMLIRPAYRCYLLLSEEHPDHRKLYEYIREGWAEYIPYLGKNEYPAWFGDSFREYAFKTFVPETDFRVSSLFIKEGVLKGQQVKASFSFSLKGIVNRGSFVYFERLPVGFHPVLMQYELADFAFTDWTLQAATQMVNLYQLEEEGKIVQLF

SEQ ID NO: 252 - DNA, 97 bp, Odoribacter splanchnicus DSM 20712
  misc_feature (1)..(97): CRISPR
cttttaattgaactaaggtagaattgaaactaggaataaaccgtacccaaccacgtagccatatacgcttttaattgaactaaggtagaattgaaac

SEQ ID NO: 253 - DNA, 711 bp, Bacillus halodurans C-125
  misc_feature (1)..(711): Cas5
atgagaaacgaagtccaatttgagctatttggagactacgcgctttttaccgatccgctcacgaagattggtggggagaagctttcctacagtgtccctacctatcaagcgttgaaaggaattgccgaaagcatctactggaagccgacgattgtctttgttatcgatgagcttcgggtgatgaagccgattcagatggagtctaaaggggtgcgtccgattgaatatggcgggggtaatacgcttgcccattatacgtatttaaaagatgtgcattatcaggtaaaggcccattttgaattcaatcttcaccgacctgacttggcgtttgaccgcaatgaagggaagcattacagcattcttcagcgttctttgaaagctggggggcggagagatatttttcttggggcgagagagtgccaaggatatgtagctccgtgtgagtttgggagtggcgacggtttttatgatggacaagggaagtatcatttaggaacgatggttcatggatttaactatcctgatgagacgggtcaacatcagcttgatgtgcgtttatggtctgctgtaatggagaatgggtacatccaatttccaaggcccgaagactgtccgattgtccgacctgtgaaagagatggagcccaaaatctttaatccagacaatgttcaatctgccgagcaattactccatgacttaggaggtgagtga

SEQ ID NO: 254 - DNA, 1884 bp, Bacillus halodurans C-125
  misc_feature (1)..(1884): Cas8
atgagttggttgcttcacctatacgaaacctatgaagccaatctcgatcaggttgggaaaacggtgaaaaagggagaggatcgagaatacacattgctgccgatctcccatacgacccaaaatgctcatatcgaagtaacacttgacgaagatggcgactttctaagagcaaaagcattaacgaaagagagcacgttaatcccttgtacagaagaggctgccagtcgctcaggttcaaaggttgcaccgtaccctcttcacgataagcttagctatgttgctggtgattttgtcaaatacggaggaaagatcaaaaatcaagacgatgctccttttgacacctatataaaaaatttaggtgagtgggccaattccccgtatgcgacggagaaggtgaagtgcatttatacgtatttgaaaaaagggcgattgattgaagacttggtcgacgcaggtgtccttaagctcgatgaaaaccaacaattgatcgaaaaatgggaaaagcgatatgaagagctactgggggaaaagcccgctattttttcaagtggtgctaccgatcaagcgagtgcttttgtgagattcaatgtttttcaccctgagtcgatcgacgatgtttggaaagacaaagagatgtttgattcatttatttctttttataatgacaaattaggcgaagaggatatttgtttcgtcacagggaacaggcttcctagcacagaacgccatgcaaataagatccgtcatgcggcggataaggcaaaattaatatcagctaatgataactctggttttaccttccgtgggcgatttaaaacaagtcgagaagccgtgggcattagctatgaggtttctcaaaaggcccataatgctttgaaatggctcattcatcgccaaagtaaaagcattgatgatcgtgtgtttcttgtttggagtaatgataacagtcttgtgcctaacccagatgaggatgcggtagacatcatgaagcatgccaaccgtgagttagaaagagatccagatacagggcaaatttttgcaggtgaagttaagaaagcgatcggcggctatcggagtgacttgaactatcaaccagaggttcatattctcgttcttgattcagcaacgactgggagaatggccgttctttattatcgaagtctcaataaagaactctatttgaatcgtttagaggcgtggcatgattcgtgtgcatgggagcaccggtatcgaagggacgaaaaggagtttatttcgttttatggggcacctgcaacgaaggatattgcatttgccgcttatggaccgagagcgagtgaaaaggtcataaaagacttaatggaacgaatgcttccttgtattgtcgatgggcgtcgggtcccaaaggatattgttagaagtgccttccaacgggcttcaaatccggtctcgatggagcgctgggaatgggaaaaaacattaagtatcacatgtgcccttattagaaaaatgcacattgaacaaaaggaggaatggggcgtgccacttgataaaagctcaacggaccgcagctacttgtttggacgcttgctggctgttgctgatgtgttggagcgaggggctctcggtaaggacgaaacaagagctaccaatgctattcgttatatgaactcatattcaaaaaatccaggacgtacgtggaaaacgattcaggaaagcttgcagccgtaccaagccaaactcggaactaaagcgacttatttatcaaagctagtcgacgagatcggcgatcaatttgagccaggggactttaacaacaaccctctgacggaacaatatttgcttgggttttatagtcaacgtcgtgagctttataagaaaaaagaggaggagaccaaccaatga

SEQ ID NO: 255 - DNA, 852 bp, Bacillus halodurans C-125
  misc_feature (1)..(852): Cas7
atgactatacttgaccacaaaattgattttgctgttattctatctgttactaaagccaatccgaatggagatccccttaacggaaaccgcccacgtcaaaattacgatgggcatggggagatttctgatgttgcgatcaagcgtaaaattcgcaatcgtttgctagatatggaagaacctatttttgttcaatctgatgaccgtaaagcagattcttttaaaagtttgcgagatcgtgcagattcgaatcctgagttagccaaaatgctgaaagcaaaaaatgcgtctgttgatgaatttgcaaaaattgcttgtcaagagtggatggatgtgcgtagttttggacaagtatttgcgtttaaaggctccaatttatccgttggtgttcgcggtcctgtgtcgattcacacagcaacgagcattgatcctattgatattgttagcacccagattacaaaaagtgttaactcggtcacgggtgataaacgtagctcagacaccatgggaatgaagcaccgtgtcgactttggtgtttatgtgttcaaagggagcattaacacgcagcttgcagagaaaacaggctttacgaatgaagatgcggaaaaaatcaagcgggcactcatcaccctgtttgaaaatgacagctcttccgcccgccctgatgggagcatggaggtccataaagtgtactggtgggagcattcttcaaagcttggacaatattcttctgccaaagtgcatcgttcattaaaaattgaatcaaagacggatacacctaagagttttgatgattatgccgttgaactatatgaattagatggcttgggtgttgaagtgattgatggccagtaa

SEQ ID NO: 256 - DNA, 711 bp, Bacillus halodurans C-125
  misc_feature (1)..(711): Cas5
atgcggaacgaggtgcagtttgagctgttcggcgattacgccctgtttaccgaccccctgacaaagatcggcggcgagaagctgtcctactctgtgcctacctatcaggccctgaagggcatcgccgagtccatctattggaagccaacaatcgtgttcgtgatcgatgagctgagagtgatgaagcccatccagatggagtctaagggcgtgaggcctatcgagtatggcggcggcaacaccctggcccactacacatatctgaaggacgtgcactaccaggtgaaggcccacttcgagtttaatctgcacagacccgatctggcctttgacaggaacgagggcaagcactactctatcctgcagcgcagcctgaaggcaggaggccggagagacatcttcctgggagcaagggagtgccagggatatgtggccccttgtgagtttggctctggcgatggcttctacgacggccagggcaagtatcacctgggcaccatggtgcacggcttcaattacccagatgagacaggccagcaccagctggacgtgaggctgtggtccgccgtgatggagaacggctatatccagtttcctagaccagaggattgccccatcgtgaggcctgtgaaggagatggagccaaagatcttcaatcccgataacgtgcagagcgccgagcagctgctgcacgacctgggaggagagtaa

SEQ ID NO: 257 - DNA, 1884 bp, Bacillus halodurans C-125
  misc_feature (1)..(1884): Cas8
atgagctggctgctgcacctgtacgagacatatgaggccaatctggatcaagtgggcaagaccgtgaagaagggcgaggacagagagtacacactgctgccaatctcccacaccacacagaacgcccacatcgaggtgaccctggacgaggatggcgacttcctgagggccaaggccctgaccaaggagtctacactgatcccatgcacagaggaggcagcctcccgctctggcagcaaggtggcaccataccctctgcacgataagctgagctatgtggccggcgactttgtgaagtacggcggcaagatcaagaatcaggacgatgccccattcgacacctatatcaagaatctgggagagtgggcaaacagcccatacgcaaccgagaaggtgaagtgtatctacacatatctgaagaagggccgcctgatcgaggatctggtggacgccggcgtgctgaagctggatgagaaccagcagctgatcgagaagtgggagaagcggtacgaggagctgctgggcgagaagcctgccatctttagctccggcgcaaccgaccaggccagcgccttcgtgcggttcaacgtgttccacccagagtccatcgacgacgtgtggaaggataaggagatgttcgactcctttatctctttctataacgataagctgggcgaggaggacatctgcttcgtgaccggcaatcggctgcccagcacagagagacacgccaacaagatcaggcacgccgccgataaggccaagctgatcagcgccaatgacaactccggctttaccttccggggccggttcaagaccagccgggaggcagtgggaatcagctacgaggtgtcccagaaggcccacaatgccctgaagtggctgatccaccgccagtccaagtctatcgacgatcgggtgttcctggtgtggtctaatgataacagcctggtgccaaatcccgatgaggacgccgtggacatcatgaagcacgccaacagggagctggagcgcgatccagacaccggacagatcttcgcaggagaggtgaagaaggcaatcggaggctaccgcagcgatctgaactatcagcccgaggtgcacatcctggtgctggactctgccaccacaggccgcatggccgtgctgtactatcggagcctgaataaggagctgtacctgaaccgcctggaggcctggcacgattcttgtgcctgggagcaccggtatcggagagacgagaaggagtttatcagcttctacggcgcccccgccaccaaggatatcgcctttgccgcatatggacctagggcctccgagaaagtgatcaaggacctgatggagcggatgctgccttgcatcgtggatggcaggcgcgtgccaaaggacatcgtgcggagcgccttccagagagcctccaatcccgtgtctatggagagatgggagtgggagaagaccctgtccatcacatgtgccctgatcaggaagatgcacatcgagcagaaggaggagtggggcgtgcctctggataagtctagcaccgaccgcagctacctgtttggccggctgctggccgtggcagatgtgctggagaggggcgccctgggcaaggacgagaccagagccacaaacgccatcaggtacatgaatagctattccaagaaccctggccgcacctggaagacaatccaggagtccctgcagccatatcaggccaagctgggcaccaaggccacatacctgtctaagctggtggatgagatcggcgaccagtttgagcctggcgacttcaacaataacccactgaccgagcagtacctgctgggcttctatagccagcggagagagctgtacaagaagaaggaggaggagacaaaccagtaa

SEQ ID NO: 258 - DNA, 852 bp, Bacillus halodurans C-125
  misc_feature (1)..(852): Cas7
atgaccatcctggatcacaagatcgacttcgccgtgatcctgtccgtgacaaaggccaatcctaacggcgacccactgaatggcaacaggcctcgccagaattacgatggccacggcgagatctctgacgtggccatcaagagaaagatcagaaacagactgctggatatggaggagcccatctttgtgcagagcgacgataggaaggccgactctttcaagagcctgagggatcgcgccgactccaatcctgagctggccaagatgctgaaggccaagaacgcctctgtggatgagtttgccaagatcgcctgccaggagtggatggacgtgcgctccttcggccaggtgttcgcctttaagggctccaatctgtctgtgggcgtgcggggacccgtgagcatccacaccgccacaagcatcgatccaatcgacatcgtgtctacccagatcacaaagagcgtgaactccgtgaccggcgataagagaagctccgacacaatgggcatgaagcacagggtggattttggcgtgtacgtgttcaagggctccatcaatacccagctggccgagaagaccggctttacaaacgaggacgccgagaagatcaagagagccctgatcacactgttcgagaacgattctagctccgccaggcctgacggctccatggaggtgcacaaggtgtattggtgggagcactctagcaagctgggccagtactcctctgccaaggtgcaccggagcctgaagatcgagtccaagaccgatacaccaaagagcttcgacgattacgccgtggagctgtatgagctggatggcctgggcgtggaagtgatcgacggacagtaa

SEQ ID NO: 259 - protein, 236 aa, Bacillus halodurans C-125
  misc_feature (1)..(236): Cas5
MRNEVQFELFGDYALFTDPLTKIGGEKLSYSVPTYQALKGIAESIYWKPTIVFVIDELRVMKPIQMESKGVRPIEYGGGNTLAHYTYLKDVHYQVKAHFEFNLHRPDLAFDRNEGKHYSILQRSLKAGGRRDIFLGARECQGYVAPCEFGSGDGFYDGQGKYHLGTMVHGFNYPDETGQHQLDVRLWSAVMENGYIQFPRPEDCPIVRPVKEMEPKIFNPDNVQSAEQLLHDLGGE

SEQ ID NO: 260 - protein, 627 aa, Bacillus halodurans C-125
  misc_feature (1)..(627): Cas8
MSWLLHLYETYEANLDQVGKTVKKGEDREYTLLPISHTTQNAHIEVTLDEDGDFLRAKALTKESTLIPCTEEAASRSGSKVAPYPLHDKLSYVAGDFVKYGGKIKNQDDAPFDTYIKNLGEWANSPYATEKVKCIYTYLKKGRLIEDLVDAGVLKLDENQQLIEKWEKRYEELLGEKPAIFSSGATDQASAFVRFNVFHPESIDDVWKDKEMFDSFISFYNDKLGEEDICFVTGNRLPSTERHANKIRHAADKAKLISANDNSGFTFRGRFKTSREAVGISYEVSQKAHNALKWLIHRQSKSIDDRVFLVWSNDNSLVPNPDEDAVDIMKHANRELERDPDTGQIFAGEVKKAIGGYRSDLNYQPEVHILVLDSATTGRMAVLYYRSLNKELYLNRLEAWHDSCAWEHRYRRDEKEFISFYGAPATKDIAFAAYGPRASEKVIKDLMERMLPCIVDGRRVPKDIVRSAFQRASNPVSMERWEWEKTLSITCALIRKMHIEQKEEWGVPLDKSSTDRSYLFGRLLAVADVLERGALGKDETRATNAIRYMNSYSKNPGRTWKTIQESLQPYQAKLGTKATYLSKLVDEIGDQFEPGDFNNNPLTEQYLLGFYSQRRELYKKKEEETNQ

SEQ ID NO: 261 - protein, 283 aa, Bacillus halodurans C-125
  misc_feature (1)..(283): Cas7
MTILDHKIDFAVILSVTKANPNGDPLNGNRPRQNYDGHGEISDVAIKRKIRNRLLDMEEPIFVQSDDRKADSFKSLRDRADSNPELAKMLKAKNASVDEFAKIACQEWMDVRSFGQVFAFKGSNLSVGVRGPVSIHTATSIDPIDIVSTQITKSVNSVTGDKRSSDTMGMKHRVDFGVYVFKGSINTQLAEKTGFTNEDAEKIKRALITLFENDSSSARPDGSMEVHKVYWWEHSSKLGQYSSAKVHRSLKIESKTDTPKSFDDYAVELYELDGLGVEVIDGQ

SEQ ID NO: 262 - DNA, 99 bp, Bacillus halodurans C-125
  misc_feature (1)..(99): Exemplary minimal CRISPR array
gtcgcactcttcatgggtgcgtggattgaaatcctttgacggagaggggaacaggaaattagagaaggtcgcactcttcatgggtgcgtggattgaaat

SEQ ID NO: 263 - DNA, 684 bp, Desulfovibrio vulgaris
  misc_feature (1)..(684): Cas5, Desulfovibrio vulgaris RCH1 plasmid pDEVAL01
atgacacatggggctgttaagacatacggcatcagactgcgggtatggggcgactacgcctgcttcacgcggccggagatgaaggtggaacgggtgtcatacgatgtcatgcccccttccgccgcacggggcatccttgaggccatccactggaagccggccatcaggtggattgtggacaggattcatgtgctgcggcccatcgtcttcgacaacgtgcggcgcaacgaggtcagttcgaagatacccaagcccaatccggcaacggccatgcgcgacaggaagccgctctactttctggtcgatgacggcagcaaccgccagcaacgggcggcgaccctgctgcgcaacgtcgactatgtcatcgaagcccacttcgaactgacagacaaggccggagcggaagacaacgcgggcaagcatctggacatcttcaggcgtcgtgcgcgcgccgggcagtcgttccagcagccatgcctcggctgccgcgagtttccggcgtcgttcgaactgctggagggggatgtgccgctctcgtgctacgcgggcgagaagcgcgaccttggctacatgctgctcgacatcgacttcgaacgcgacatgacgccgctgttcttcaaggccgtcatggaagacggagtgataacgcccccgtcgcgcacgtcaccggaggtgagggcatga

SEQ ID NO: 264 - DNA, 1839 bp, Desulfovibrio vulgaris
  misc_feature (1)..(1839): Cas8, Desulfovibrio vulgaris RCH1 plasmid pDEVAL01
atgatcctgcaggcattgcatggctattaccagcgcatgagcgcagaccccgatgcggggatgccgccctacgggaccagcatggagaacatctcgttcgcgctggtgctggatgcgaaagggacgctacggggcatcgaggacttgcgggaacaggaaggcaagaagctgcggccccgcaagatgctggttcctatcgcggaaaagaaggggaacggcatcaaaccgaacttcctgtgggagaacaccagttatattctgggggtggacgccaagggcaagcaggaacgtacagacaagtgccacgccgcgttcattgcccacatcaaggcctactgtgacactgcagaccaagaccttgccgccgttctgcagttccttgaacacggcgaaaaagacctctccgcttttccggtttcggaagaggtcatcggctccaatatcgtctttcgcatcgagggcgaaccgggcttcgtccatgagcgtccggctgcgcggcaggcttgggccaactgcctgaaccggcgggagcaagggctatgtggtcaatgcctcatcaccggggagcgccagaagccgattgcccaactccatccgtcgatcaaaggcgggcgagacggcgttcgcggtgcacaggctgttgcctcgatagtgtcctttaacaacaccgcctttgaatcttacgggaaagaacagtcgatcaatgcacccgtcagtcaagaagcggcattctcttatgtcacagccctgaattacctgctcaacccgtcaaatcgacagaaggtcaccatcgctgacgccaccgtggtcttctgggccgaacgcagcagcccggcagaggacatctttgcaggcatgttcgacccgccttccaccacggcgaaaccggagtcctcgaacgggacgccgccggaagacagtgaagaaggcagccagcctgacacagccagagacgacccccatgccgctgccagaatgcacgacctgcttgtggccatccgttccggcaagcgcgccacggacatcatgcccgacatggacgagtccgtgcgcttccatgtgcttggcctgtcgcccaacgccgcccgcctgtccgtccgcttctgggaggtcgataccgtcggtcacatgctggacaaggtggggcggcactaccgtgaactcgagatcattccgcaattcaacaacgagcaggagttcccgtctctttcaaccctgctgcggcagactgccgtcttgaacaagaccgagaacatctcgcctgtacttgcaggcgggctattcagggccatgctcaccggcgggccctatccgcaaagcctgttgcccgccgtgcttggacgcatccgcgccgagcacgccagaccagaagataaaagccgctataggcttgaagttgtgacgtattatcgagccgccttgatcaaggcgtatctcataagaaacagaaagctggaggtgcccgtgtctctcgaccccgcaagaacagaccgcccgtacctgctcggacgactcttcgccgttctggaaaaagcgcaggaagatgccgtgcccggtgcgaacgccaccatcaaggaccgctatctggcctccgcatcggccaatccggggcaggtattccacatgctgctcaagaatgcgtccaaccacacggccaaactccgcaaggaccctgaaagaaaggggtcggccatccactacgaaatcatgatgcaagagattatcgacaacatcagcgattttccggtgaccatgtcgtccgacgaacaaggcctgttcatgatcggctactaccaccagcgcaaggcccttttcaccaagaagaacaaggagaactag

SEQ ID NO: 265 - DNA, 873 bp, Desulfovibrio vulgaris
  misc_feature (1)..(873): Cas7, Desulfovibrio vulgaris RCH1 plasmid pDEVAL01
atgaccgccattgccaacagatacgagttcgtgctgcttttcgatgtggagaacggcaaccccaacggcgaccccgacgcgggcaacatgccgcgcatcgaccccgagaccgggcatggtctggtcaccgacgtgtgcctgaagcgcaagatacgcaaccatgtggccctgacaaaagaaggtgccgagcggttcaatatctatattcaggaaaaggccattctcaacgaaacccacgaacgcgcctacacggcctgcgacctgaaacccgaacccaagaaactgcccaagaaggtcgaagacgccaagagggtcaccgactggatgtgcacgaacttctacgacatccgcacgttcggcgccgtcatgaccacagaggtcaactgcgggcaggtgcgcggccccgtgcagatggcctttgccagaagtgtggaacccgtcgtgccgcaagaggtgagcatcacccgcatggcagtcaccacgaaggcagaggccgaaaagcagcagggagacaaccgcaccatgggtcgcaagcacatcgtgccctacggcctgtatgtggcgcacggcttcatctccgcaccgctggcagagaagacaggcttctccgatgaagacctgacgctgttctgggacgccctcgtcaacatgttcgagcacgaccgttcggcggcacgcggcctcatgagcagccgcaaactcatcgtcttcaagcaccagaacaggctcggcaacgcccccgcccacaagttgttcgacctcgtgaaggtcagccgtgcagagggttcgtccggccccgcccggtcgtttgccgactatgcggtgacagtggggcaggcccccgaaggcgtagaggtcaaagagatgctgtag

SEQ ID NO: 266 - DNA, 684 bp, Desulfovibrio vulgaris
  misc_feature (1)..(684): Cas5, Desulfovibrio vulgaris RCH1 plasmid pDEVAL01
atgacccacggagcagtgaagacatacggcatcagactgagggtgtggggcgactatgcctgttttacccggcctgagatgaaggtggagagagtgagctacgatgtgatgccaccatccgccgcaaggggcatcctggaggcaatccactggaagccagccatcagatggatcgtggacagaatccacgtgctgcgccccatcgtgttcgataatgtgcggagaaacgaggtgtcctctaagatccctaagccaaacccagcaacagcaatgagggataggaagcccctgtattttctggtggacgatggctccaacaggcagcagagggcagccaccctgctgcggaatgtggactacgtgatcgaggcccacttcgagctgacagacaaggccggcgccgaggataatgccggcaagcacctggatatcttcaggcgccgggcaagggcaggacagagctttcagcagccttgcctgggctgtcgcgagtttccagcctccttcgagctgctggagggcgacgtgccactgtcttgctacgcaggcgagaagcgggatctgggctatatgctgctggacatcgatttcgagagagacatgaccccactgttctttaaggccgtgatggaggatggcgtgatcacccctccatctaggacaagccccgaggtgcgcgcataa

SEQ ID NO: 267 - DNA, 1839 bp, Desulfovibrio vulgaris
  misc_feature (1)..(1839): Cas8, Desulfovibrio vulgaris RCH1 plasmid pDEVAL01
atgatcctgcaggccctgcacggatactatcagagaatgtccgccgaccctgatgcaggaatgccaccctacggcaccagcatggagaatatctccttcgccctggtgctggacgccaagggcacactgaggggcatcgaggatctgcgcgagcaggagggcaagaagctgagaccaaggaagatgctggtgcccatcgccgagaagaagggcaatggcatcaagccaaactttctgtgggagaataccagctatatcctgggcgtggacgccaagggcaagcaggagaggaccgataagtgccacgccgccttcatcgcccacatcaaggcctactgtgacaccgcagaccaggatctggcagccgtgctgcagttcctggagcacggcgagaaggatctgtctgcctttcccgtgagcgaggaagtgatcggctccaacatcgtgttcagaatcgagggcgagcccggctttgtgcacgagagacctgcagcaaggcaggcctgggccaattgtctgaacaggagggagcagggactgtgcggacagtgtctgatcaccggcgagaggcagaagcctatcgcccagctgcacccaagcatcaagggaggaagggacggcgtgcggggagcacaggccgtggccagcatcgtgtcctttaacaataccgccttcgagtcttacggcaaggagcagagcatcaacgcacccgtgtcccaggaggcagccttttcttacgtgacagccctgaattatctgctgaatccttccaacaggcagaaggtgaccatcgccgatgccacagtggtgttctgggcagagcgcagctccccagcagaggacatctttgccggcatgttcgatcctccatctaccacagccaagcccgagtctagcaacggaaccccccctgaggactctgaggagggcagccagccagatacagcaagggacgatccacacgcagcagcaaggatgcacgacctgctggtggccatcagatctggcaagagggccaccgatatcatgcccgacatggatgagagcgtgagatttcacgtgctgggcctgtctcctaatgcagcaaggctgagcgtgcggttctgggaggtggacacagtgggccacatgctggataaagtgggcagacactatagggagctggagatcatccctcagtttaacaatgagcaggagttcccatccctgtctaccctgctgagacagacagccgtgctgaataagaccgagaacatctctccagtgctggccggaggactgttcagggcaatgctgacaggaggaccttacccacagagcctgctgccagccgtgctgggacgcatccgggcagagcacgcacggcctgaggacaagtccagatacaggctggaggtggtgacctactatagagccgccctgatcaaggcctatctgatccgcaaccggaagctggaggtgcccgtgtccctggaccctgcaaggaccgataggccatatctgctgggccgcctgtttgccgtgctggagaaggcacaggaggacgcagtgcctggagccaacgccacaatcaaggatcggtacctggccagcgcctccgccaatccaggacaggtgttccacatgctgctgaagaatgcctccaaccacaccgccaagctgcggaaggaccctgagagaaagggctctgccatccactacgagatcatgatgcaggagatcatcgacaatatcagcgatttcccagtgaccatgtcctctgatgagcagggcctgtttatgatcggctactatcaccagaggaaggccctgttcacaaagaagaataaggagaactaa

SEQ ID NO: 268 - DNA, 873 bp, Desulfovibrio vulgaris
  misc_feature (1)..(873): Cas7, Desulfovibrio vulgaris RCH1 plasmid pDEVAL01
atgaccgcaatcgcaaaccgctatgagtttgtgctgctgttcgacgtggagaacggcaatccaaacggcgaccccgatgccggcaatatgcctaggatcgacccagagaccggacacggactggtgacagacgtgtgcctgaagagaaagatcaggaaccacgtggccctgacaaaggagggcgccgagaggttcaacatctacatccaggagaaggccatcctgaatgagacccacgagcgcgcctatacagcctgtgacctgaagccagagcccaagaagctgccaaagaaggtggaggacgccaagcgggtgaccgattggatgtgcacaaacttttacgatatcagaaccttcggcgccgtgatgaccacagaagtgaattgtggacaggtgcggggaccagtgcagatggcctttgccagatccgtggagcccgtggtgcctcaggaggtgtctatcacccggatggccgtgaccacaaaggccgaggccgagaagcagcagggcgacaacagaacaatgggcaggaagcacatcgtgccatacggcctgtatgtggcacacggcttcatcagcgcccccctggccgagaagaccggcttttccgacgaggatctgacactgttctgggacgccctggtgaatatgtttgagcacgatcgctccgccgcaaggggactgatgagctcccggaagctgatcgtgtttaagcaccagaatagactgggcaacgcccctgcccacaagctgttcgacctggtgaaggtgtctagggcagagggctctagcggccctgcacgcagcttcgccgattatgcagtgaccgtgggacaggccccagagggagtggaggtgaaggagatgctgtaa

SEQ ID NO: 269 - protein, 227 aa, Desulfovibrio vulgaris
  misc_feature (1)..(227): Cas5, Desulfovibrio vulgaris RCH1 plasmid pDEVAL01
MTHGAVKTYGIRLRVWGDYACFTRPEMKVERVSYDVMPPSAARGILEAIHWKPAIRWIVDRIHVLRPIVFDNVRRNEVSSKIPKPNPATAMRDRKPLYFLVDDGSNRQQRAATLLRNVDYVIEAHFELTDKAGAEDNAGKHLDIFRRRARAGQSFQQPCLGCREFPASFELLEGDVPLSCYAGEKRDLGYMLLDIDFERDMTPLFFKAVMEDGVITPPSRTSPEVRA

SEQ ID NO: 270 - protein, 612 aa, Desulfovibrio vulgaris
  misc_feature (1)..(612): Cas8, Desulfovibrio vulgaris RCH1 plasmid pDEVAL01
MILQALHGYYQRMSADPDAGMPPYGTSMENISFALVLDAKGTLRGIEDLREQEGKKLRPRKMLVPIAEKKGNGIKPNFLWENTSYILGVDAKGKQERTDKCHAAFIAHIKAYCDTADQDLAAVLQFLEHGEKDLSAFPVSEEVIGSNIVFRIEGEPGFVHERPAARQAWANCLNRREQGLCGQCLITGERQKPIAQLHPSIKGGRDGVRGAQAVASIVSFNNTAFESYGKEQSINAPVSQEAAFSYVTALNYLLNPSNRQKVTIADATVVFWAERSSPAEDIFAGMFDPPSTTAKPESSNGTPPEDSEEGSQPDTARDDPHAAARMHDLLVAIRSGKRATDIMPDMDESVRFHVLGLSPNAARLSVRFWEVDTVGHMLDKVGRHYRELEIIPQFNNEQEFPSLSTLLRQTAVLNKTENISPVLAGGLFRAMLTGGPYPQSLLPAVLGRIRAEHARPEDKSRYRLEVVTYYRAALIKAYLIRNRKLEVPVSLDPARTDRPYLLGRLFAVLEKAQEDAVPGANATIKDRYLASASANPGQVFHMLLKNASNHTAKLRKDPERKGSAIHYEIMMQEIIDNISDFPVTMSSDEQGLFMIGYYHQRKALFTKKNKEN

SEQ ID NO: 271 - protein, 290 aa, Desulfovibrio vulgaris
  misc_feature (1)..(290): Cas7, Desulfovibrio vulgaris RCH1 plasmid pDEVAL01
MTAIANRYEFVLLFDVENGNPNGDPDAGNMPRIDPETGHGLVTDVCLKRKIRNHVALTKEGAERFNIYIQEKAILNETHERAYTACDLKPEPKKLPKKVEDAKRVTDWMCTNFYDIRTFGAVMTTEVNCGQVRGPVQMAFARSVEPVVPQEVSITRMAVTTKAEAEKQQGDNRTMGRKHIVPYGLYVAHGFISAPLAEKTGFSDEDLTLFWDALVNMFEHDRSAARGLMSSRKLIVFKHQNRLGNAPAHKLFDLVKVSRAEGSSGPARSFADYAVTVGQAPEGVEVKEML

SEQ ID NO: 272 - DNA, 97 bp, Desulfovibrio vulgaris
  misc_feature (1)..(97): CRISPR, Desulfovibrio vulgaris RCH1 plasmid pDEVAL01
gtcgccccccacgcgggggcgtggattgaaaccagtctcgttaccctgtcgcggagggcgtcgatgtcgccccccacgcgggggcgtggattgaaac

SEQ ID NO: 273 - DNA, 711 bp, Geobacillus thermocatenulatus strain KCTC 3921
  misc_feature (1)..(711): Cas5
atgcagcgtcgagcgaaagtgcaggtgaaggtgtggggggaatatgcttgttttacaagaccagaatttaaagtcgagcgcatcagttatcctgtgatgacgccgagcgcagcgcggggggtattggaagcgatcttttggaagcccgaatttcgctacgaggttcgacaaatcgggattttaagtttaggggggcaacaagcgattttgcgcaacgaactcacaagcaagcaaaataaaaacccgatcgtgattgaaagcgccagggctcaacgaacgagcttgattttaaagaacgtggcgtattggatagttgccgatatcattttaacaaatcgagcggttgatccagcggccaaataccgggatcagtttaaccgacgagttgaacgaggtcagtgtcatcatacgccatatttaggaacaagggagtttgccgcctacttttcatctatagatgaagatgatgttgtgaagccggtcgatatggacattggcacaatgctgttggattttgcttttattgaagacggttcgagaaaagaaatggagtttctccgttatgaagaaacggggacgcgaacggcggttggattcgcgaagccactcttttttgaggcaaaggtagaaaacggttggctgcatgttccaaaagaaacatatcagcagctgtatgcattggagggacaaaatgctttacgagttgattga

SEQ ID NO: 274 - DNA, 1776 bp, Geobacillus thermocatenulatus strain KCTC 3921
  misc_feature (1)..(1776): Cas8
atgcattggagggacaaaatgctttacgagttgattgagttggcggctaagttgcagagggaaaaaaaactaccaccgatctcctataaacctaaatcaatcaattggattattgatttaggtggggatcaaccatatttgaaagggccgtttagaaggggagaataccgtttggtggaagcgccgtttcggttgaggcaagggaaagttacggaagaaaacgtaaagccttatttgttggctgatgatggccgctatgtacttggcatccctgaaagtccagaaaaggcggatgaagcggagttaatgcataaagggtatgttcgattaattgaggaagcttatgagaaaacaaagttgaaagaattaaaaaaagtgctggattttttgtacagtccgatgaagaatgcgttccgtgagcaaattggtgccaaggatatcgtgacgtttcaagatgatgaggagtcattgatttttgaaaagagtgaaattcaaacattttgggctgaatacttggcgagtgatttgctgtccgacgatgaatgtgactgttctgtttgcgggaagcgatcggcttatgtacggtatttgcccaaccctgtccagttatttggacaatcgtgccaactgacgtcgtttaataacccgtcgtttgaatcaatgggcaaaactcaaacgaataatgtacctgtctgcttcgggtgtgctactttggttgtcgatacattgaattatctcattagggaagatcaacatcatactcccctgtatataagcgaccgaaatattttgcaatcccaaatggccatatattgggttgatgaccaaattgaggggaggggatgtatccaacttgatgaaaaattgtttgcatcgccaatcgaacaatggctttttgatgaagatacaaatcaacggactcctccccctgagttgaagcagctcgaggaactgctggctcttccgaaaacagggcgcgagcaggcattgcacttagacaagacgttttttcatatggctgtcctttcggccaataaagcgagattagtcgttcgtgaatggattcatacgtcgatttctcaattgctgatgcatttggagaggtatgcggccgctgtgcgcatcgttcagccgactggggaaaaaggctatttattgccgctggcagctttgattcgcgctgttgatatgtcgccggggctggtgcgccaatgtttgcgcacgatttatcaaggggctttgccgcctactgaattgctgccgttagcgcttcaacgtttccgctctttgaaagtattgagtgatccgaaggaaacgtggagatatcattcatcagccagcttgttaaaactcgttctcacatatggaaaggaggaagcaaatacaatgcaatcgttaaacaaccattgcttgcagccggcttatatttgtggacgattattggccgtattggaagaaattcaacggcgcgctttgggataccgaattggaagcacaatcgtggatcgattttatggcgcggcttctacagctccagcatcgacatttggttcattgctgaggctttcaacaacagctcatctgccaaaagtgtctggtgagcttggccgtttgcttgaggaagtgatgaaacagctggatgaagctggaggtttcccgacgattttcaatttaagagaacaggcagagttcgcacttggtttttatcatcaacgcgctgagttccgcagtcgccatcaaagcaatcaaacaaatggaacgggggaaagccaatga

SEQ ID NO: 275 - DNA, 1116 bp, Geobacillus thermocatenulatus strain KCTC 3921
  misc_feature (1)..(1116): Cas7
atgatggagcgctatatcgatccgacaaaacgtcatgaatttgtgttgctttttgatgtcaaagatgggaatccaaatggggatccagatgcgggcaacatgccgcgtgtcgatccggaaacgatgcacggcattgtgaccgacgttgcgatcaagcggaaaattcgcgattacgccgcgatggtattaggcaaaccgatttttattcaaagccaaacggctttaaacaccatcatttttcaagcatatcaagacgtcggagtgaaactggcgacgattgagctgaatgaagaagaaaaagaaaatggggaattgatgaattggctttcacagcttgaggaacaaggattggtgctcgaagacaatcgggtgatctatactggtgaggacatcaaggagaaggatattcgtgaaaaattaacggaaggattagaagaagctggtcttaaaaaacaactggaaaagtcattgcgaaatatggcgaaacgtctggcacaggcggcaaataatatgaaaattgatgaacaaacacgccaaaatgcgcaaaaggctttatgccaaaagtactatgatgtccgcatgttcggggctgtgatgtcaacaggattgaatgctggtcaagtgcgtgggccgatgcagctgacattttctcgctcaattgacccggtatttccatgggatttgaccatcacacgctccgcgatcaccaaagaatcggatcgccgcagaaaacaaacggaaatgggaagaaaaccgttaattccatacggattgtatcgattgcatggattctacaatccatttttaggagaaaaaacaggggttacggcagaagatttagctgatttttgggatgcgctcgttcatttatttgcatttgaccattctgcggctcgaggagaaatgaatgtcagagcactctatatttttagccatgaaaatgcgaaaggatcagcgccagctcacaagctgtttgacttggtgaaaatcgagcgccgccaacaggaagctccaaggtcattccatgactatgttttgcttggaccggcagatgaggggcagaaagacgtttttcttgaagggttttctggggtcaccgtgacgcgcctcgtataa

SEQ ID NO: 276 - DNA, 711 bp, Geobacillus thermocatenulatus strain KCTC 3921
  misc_feature (1)..(711): Cas5
atgcagagaagggccaaggtgcaggtgaaagtgtggggcgagtacgcctgttttacacgcccagagttcaaggtggagcggatcagctatccagtgatgaccccatccgccgcaaggggcgtgctggaggccatcttttggaagcccgagttcagatacgaggtgaggcagatcggcatcctgagcctgggaggacagcaggcaatcctgcggaacgagctgacatccaagcagaacaagaatcctatcgtgatcgagtctgccagggcacagcggaccagcctgatcctgaagaacgtggcctactggatcgtggccgatatcatcctgacaaatagggcagtggaccccgcagccaagtatagagaccagttcaatcgccgggtggagaggggacagtgccaccacacaccttacctgggcacccgcgagtttgccgcctatttcagctccatcgacgaggacgatgtggtgaagccagtggacatggatatcggcaccatgctgctggatttcgcctttatcgaggacggcagcagaaaggagatggagtttctgagatacgaggagaccggaacacgcaccgcagtgggattcgcaaagccactgttctttgaggccaaggtggagaacggctggctgcacgtgcccaaggagacctaccagcagctgtatgccctggagggccagaatgccctgagggtggattaa

SEQ ID NO: 277 - DNA, 1776 bp, Geobacillus thermocatenulatus strain KCTC 3921
  misc_feature (1)..(1776): Cas8
atgcactggagagataagatgctgtatgagctgatcgagctggccgccaagctgcagagggagaagaagctgcctccaatcagctacaagcccaagtccatcaactggatcatcgatctgggaggcgaccagccttacctgaagggaccatttcgccggggagagtataggctggtggaggcacctttccgcctgaggcagggcaaggtgaccgaggagaatgtgaagccatacctgctggccgacgatggcagatatgtgctgggcatcccagagtcccccgagaaggcagacgaggcagagctgatgcacaagggctacgtgaggctgatcgaggaggcctatgagaagacaaagctgaaggagctgaagaaggtgctggattttctgtattctcctatgaagaacgccttccgggagcagatcggcgccaaggacatcgtgacattccaggacgatgaggagagcctgatctttgagaagtccgagatccagaccttctgggccgagtacctggcctccgatctgctgtctgacgatgagtgcgactgtagcgtgtgcggcaagagaagcgcctacgtgaggtatctgccaaatcccgtgcagctgtttggccagtcttgtcagctgaccagctttaacaatccctctttcgagagcatgggcaagacacagaccaacaatgtgcccgtgtgcttcggctgtgccacactggtggtggataccctgaactacctgatcagagaggaccagcaccacacacctctgtatatctccgataggaatatcctgcagtctcagatggccatctactgggtggacgatcagatcgagggcagaggctgcatccagctggacgagaagctgtttgcctctcctatcgagcagtggctgttcgacgaggatacaaaccagcgcaccccccctccagagctgaagcagctggaggagctgctggccctgccaaagacaggaagggagcaggccctgcacctggacaagaccttctttcacatggccgtgctgtccgccaataaggcaaggctggtggtgcgggagtggattcacacctccatctctcagctgctgatgcacctggagcggtacgcagcagccgtgcggatcgtgcagcctacaggcgagaagggctatctgctgccactggccgccctgatcagggcagtggatatgagcccaggcctggtgagacagtgtctgaggacaatctatcagggcgccctgccacctaccgagctgctgcccctggccctgcagcggttcagaagcctgaaggtgctgtctgaccctaaggagacctggagataccactctagcgcctctctgctgaagctggtgctgacatatggcaaggaggaggccaacaccatgcagagcctgaacaatcactgcctgcagcccgcctacatctgtggcaggctgctggccgtgctggaggagatccagagaagggccctgggctaccggatcggctctaccatcgtggatcggttctacggagcagccagcacagcacctgccagcaccttcggctccctgctgaggctgagcaccacagcacacctgccaaaggtgtccggcgagctgggccggctgctggaggaagtgatgaagcagctggacgaggcaggaggatttccaacaatcttcaatctgagggagcaggcagagtttgcactgggcttctaccaccagagggcagagttccgctctcggcaccagagcaaccagacaaatggcaccggcgagtcccagtaa

SEQ ID NO: 278 - DNA, 1116 bp, Geobacillus thermocatenulatus strain KCTC 3921
  misc_feature (1)..(1116): Cas7
atgatggagagatatatcgatcccaccaagaggcacgagtttgtgctgctgttcgacgtgaaggatggcaaccctaatggcgacccagatgcaggaaacatgccccgggtggaccctgagacaatgcacggcatcgtgaccgatgtggccatcaagagaaagatcagggactatgccgccatggtgctgggcaagcctatctttatccagtctcagacagccctgaacaccatcatcttccaggcctaccaggatgtgggcgtgaagctggccaccatcgagctgaatgaggaggagaaggagaacggcgagctgatgaattggctgagccagctggaggagcagggactggtgctggaggacaatagagtgatctacacaggcgaggatatcaaggagaaggacatcagggagaagctgaccgagggcctggaggaggcaggcctgaagaagcagctggagaagagcctgcgcaacatggcaaagcggctggcccaggccgccaacaatatgaagatcgatgagcagacccgccagaatgcccagaaggccctgtgccagaagtactatgacgtgcggatgttcggcgccgtgatgtccacaggcctgaacgcaggacaggtgaggggaccaatgcagctgaccttttcccgctctatcgatcccgtgttcccatgggacctgaccatcacaagaagcgccatcacaaaggagtccgatcggagaaggaagcagaccgagatgggccgcaagcccctgatcccttacggcctgtatcggctgcacggcttttacaatcccttcctgggcgagaagacaggagtgaccgcagaggacctggcagatttttgggacgccctggtgcacctgttcgcctttgaccacagcgccgcaaggggagagatgaacgtgcgggccctgtatatcttttcccacgagaatgccaagggctctgcccctgcccacaagctgttcgatctggtgaagatcgagcgccggcagcaggaggcaccaagatccttccacgactacgtgctgctgggaccagcagatgagggacagaaggacgtgtttctggagggcttctctggcgtgaccgtgacacggctggtgtaa

SEQ ID NO: 279 - protein, 236 aa, Geobacillus thermocatenulatus strain KCTC 3921
  misc_feature (1)..(236): Cas5
MQRRAKVQVKVWGEYACFTRPEFKVERISYPVMTPSAARGVLEAIFWKPEFRYEVRQIGILSLGGQQAILRNELTSKQNKNPIVIESARAQRTSLILKNVAYWIVADIILTNRAVDPAAKYRDQFNRRVERGQCHHTPYLGTREFAAYFSSIDEDDVVKPVDMDIGTMLLDFAFIEDGSRKEMEFLRYEETGTRTAVGFAKPLFFEAKVENGWLHVPKETYQQLYALEGQNALRVD

SEQ ID NO: 280 - protein, 591 aa, Geobacillus thermocatenulatus strain KCTC 3921
  misc_feature (1)..(591): Cas8
MHWRDKMLYELIELAAKLQREKKLPPISYKPKSINWIIDLGGDQPYLKGPFRRGEYRLVEAPFRLRQGKVTEENVKPYLLADDGRYVLGIPESPEKADEAELMHKGYVRLIEEAYEKTKLKELKKVLDFLYSPMKNAFREQIGAKDIVTFQDDEESLIFEKSEIQTFWAEYLASDLLSDDECDCSVCGKRSAYVRYLPNPVQLFGQSCQLTSFNNPSFESMGKTQTNNVPVCFGCATLVVDTLNYLIREDQHHTPLYISDRNILQSQMAIYWVDDQIEGRGCIQLDEKLFASPIEQWLFDEDTNQRTPPPELKQLEELLALPKTGREQALHLDKTFFHMAVLSANKARLVVREWIHTSISQLLMHLERYAAAVRIVQPTGEKGYLLPLAALIRAVDMSPGLVRQCLRTIYQGALPPTELLPLALQRFRSLKVLSDPKETWRYHSSASLLKLVLTYGKEEANTMQSLNNHCLQPAYICGRLLAVLEEIQRRALGYRIGSTIVDRFYGAASTAPASTFGSLLRLSTTAHLPKVSGELGRLLEEVMKQLDEAGGFPTIFNLREQAEFALGFYHQRAEFRSRHQSNQTNGTGESQ

SEQ ID NO: 281 - protein, 371 aa, Geobacillus thermocatenulatus strain KCTC 3921
  misc_feature (1)..(371): Cas7
MMERYIDPTKRHEFVLLFDVKDGNPNGDPDAGNMPRVDPETMHGIVTDVAIKRKIRDYAAMVLGKPIFIQSQTALNTIIFQAYQDVGVKLATIELNEEEKENGELMNWLSQLEEQGLVLEDNRVIYTGEDIKEKDIREKLTEGLEEAGLKKQLEKSLRNMAKRLAQAANNMKIDEQTRQNAQKALCQKYYDVRMFGAVMSTGLNAGQVRGPMQLTFSRSIDPVFPWDLTITRSAITKESDRRRKQTEMGRKPLIPYGLYRLHGFYNPFLGEKTGVTAEDLADFWDALVHLFAFDHSAARGEMNVRALYIFSHENAKGSAPAHKLFDLVKIERRQQEAPRSFHDYVLLGPADEGQKDVFLEGFSGVTVTRLV

SEQ ID NO: 282 - DNA, 111 bp, Geobacillus thermocatenulatus strain KCTC 3921
  misc_feature (1)..(111): CRISPR
gttgcacccggctattaagccgggtgaggattgaaactatatcacacagcttcttagtatcatcgacaacacgtgttgcacccggctattaagccgggtgaggattgaaac

SEQ ID NO: 283 - DNA, 1263 bp, Vibrio cholerae strain L15
  misc_feature (1)..(1263): Cas8
gtgatagatccagtaatagccgccttttttgcggaacgtaaagaagcatggctaaagaagaatatcagtgcagcgatgtctgatgcagaagtcttggaaaaacaacaggagtgtgagcaaaactttctattagacaattggttgcctgatgcggccaaaagggcggggcaaatttcagtggcttcacatccttgtacctttagtcatccgagtgcgcggaaaaacaaaaatggctacgtatcgtccattattgccaagaacaaaccaagaatagatggttttcttcgctctggtaatgtgagtgttgagccagatgcacttggtaacgcagcagcattagatgtatacaagtttctcagcttagagatgagcgaccaacgttctttattggtgcatattgaacaagaaagcgagttagcaaggcaattgcttgatataccaagttgtgaatatcaggcgctacgcgatggctttttaaaaatggtcgatagcgatcaggcgtctgtttccagctcgaagattaagcaagtttatttcccgatagccgatggggaatatcatttattgtcgttattaacccattccggccatctttttgaattgcgtaaacgtctagatgcacttcgatttggtgatgcggtaaaagaggcaagagagtgcaaaaaaacgaatcactttcaccccgcgggttaccaagagatctttggtctcaccacgattgggtttggcggcacaaaaccgcaaaatatcagcgtgctcaataaccaaaacgcaggtaaagcacatttactagcctctattccacctgagttaacacctcgcgatattcgtctgccgaaaacggattttttcaaagagagttttaacgcttggcaagccaaagaagtacttgaatcgttgcatcgactctttcaaaccgactgcaacaacatcaatctccgtgatggccgtgactaccgcattcagcaatacgtagatttggtgattgaaaaaatgtggcaagtacgcctgtttcttgaagcgtattccggtgaactatcgagtgcgttgccgttggagcaaaaaatctggctctatccagagtttgctgagcagcgtcagcaagaggatgagtggctcgataaaatcattcgccacattgcgcgaggcttaatcaaccattacagccgcagcaaagtgatcactaatcccgtcacattggcagaccaagagctgctggcgatagaagaggtggttgccagcaataaggagaacttgcgatga

SEQ ID NO: 284 - DNA, 888 bp, Vibrio cholerae strain L15
  misc_feature (1)..(888): Cas5
atgaacgtattgatcttaccgcatcttaaaattcacaacgccaatgcactttcaagcccctttactgttggctttcctgccatgacggcatggctaggctttgtacatgccttagagcgcaagctcagccaagcagggttatccgatctcatgctgcatagtactgctgtagtgagccaccgttgtgatgtacagactcataaaggcgaaggtgactttgttcattcaattatcggtactgccaatccactcgataaggatggttcacgctcggcatttatcgaggaagcacgctgtcatttagatgtgtcccttgtcattgagtggagtggcaatgaagagcaagttcaacagccagagtttaccgagcagttgcaagcagtgatcgcgacgatgaaagtcgcagggggcgacgttcttgccgttgggaagccctcagttaaatctgtgatcactgaggatgatactggcagagttctgcgccagttaatgcctggttatgtgctgatcgaacgccgcgatttaatgattgacgccatgcagcaaggtgatgacgcaatagatgcgctgctgggttacctcacagtgcaccaccattgtgagcagcttgaagaccaaagtgttgtttggcatagccagcgcaaaacgagtggctggattgtgccgattgccactggttttcaaggtatttcaccgttaggtgaggcaaaaaatcagcgcgatccatcagtgccgcatcgctttgctgaaagtgtggtcacgctgggtgaatttgtcatggtgcacaaaatcaaacatctcgatgacatcctttggcaataccacccggatttagaaaacgatctttacctttgtcagaaagttaacgctatcaacgaacatcaataa

SEQ ID NO: 285 - DNA, 1032 bp, Vibrio cholerae strain L15
  misc_feature (1)..(1032): Cas7
atggctaaaaataacgacatcgcatcagtactcgcatttgaaaaaaaactagtcccatcggatggctacctctttggatgtcagtgggaaaccaaagagcaagcaaccccattaaccctgcaagagaaatcagtacgtggcactatctccaaccgtttaaaagccgcagtacaaaatgatcccgctaagcttaatgcggaagttgaaaaagcaaacttgcagcgagtggatgcctgtgcgttggggcaggatcacgatactttgaagctacatttcacactcaaagtattagggggacttgcccaaccttcggcgtgtaacaatgcgctgttcaaacagagctacagtactgcggtttcgcagtacattaccaaatatggctgtttcgaattggcgaaacgttatgccaccaaccttgccaatgcccgttttctatggcgcaaccgcgttggcgcagaagagattgaagtgcaagtcaaagcattaaacaaaggggctgagcagacttggacttttaatgccaaacaattcagtactcgccactttgatcataacgactcacagctcaatagtctggccgacagaattgctcaggcactggccagcgaaacagatcatttgatgttgcaaattgactgctatgccaaagtcggtaaagcccaagaagtttaccccagtgaagagttagtgctcgataagggcaacagcaaaaccaagaaaagtaaaatcctgtatgcagttaatgagcatgctgcgatgcattcacaaaaaattggtaacgcactgcgttccattgatacttggtacccagattacgcatctgaggagcaaagtgcaggagccattgcgattgaaccctatggcgctgttaccaatttaggaaaggcgttccgcacaccgaaagataagcaagatttttacactttctttgataaatgggcgcgtggtgaaagtttgccccgtgaagaagatgagcattacgtcatggcggtattggtgcgtggtggtgtatttggcgaaagtgacaaatag

SEQ ID NO: 286 - DNA, 639 bp, Vibrio cholerae strain L15
  misc_feature (1)..(639): Cas6
atgaactactaccaagagatcacgttattgccagatgccgacattgccttgggctttctttggcaaaacgtctttcaacaagtgcacattgctttagtggagcacaaagtggcgagcaaccaatctctggttgcggtcggttttcctgattatcgccaagcaaagtttccgctcggcgcaaagctgcgtctctttgcaaaagagcaagtaacactggaaaagttggatatccaccgctggctaactcggctagaagactatgtgcacatcaaaggggtcaaacccgtaccaagcgatgtaacttatgtaagctttgtacgcaagcaggtgaaatcgcccgaacgaatagagcgggatatgcagcaaaaagccgaactatgggcagcaaaatctggtaaaccgctggtggaatgtttagtggatttacaacaaagcaagccgacagcgttgtgctccttgccctttatttacttgcatagccagcaaaccaagcaacgttcaccagaaaaaaacagcaagttcccgctgtttattgagatgcagcagcaaagcacatctcaagatgggggcttcgattgctatggtttgagtagcaaagcgaatgggcagtcaatgttggctactgtaccgcacttttaa

SEQ ID NO: 287 - DNA, 1263 bp, Vibrio cholerae strain L15
  misc_feature (1)..(1263): Cas8
atgatcgacccagtgatcgccgccttctttgccgagaggaaggaggcctggctgaagaagaatatcagcgccgcaatgtccgatgcagaggtgctggagaagcagcaggagtgcgagcagaacttcctgctggacaattggctgcccgatgcagcaaagagggcaggacagatctctgtggccagccacccatgtacattttcccacccctctgcccgcaagaacaagaatggctacgtgtcctctatcatcgccaagaacaagccacgcatcgacggcttcctgcggtctggcaacgtgagcgtggagccagacgccctgggaaatgcagccgccctggacgtgtacaagtttctgtccctggagatgtctgatcagcgcagcctgctggtgcacatcgagcaggagagcgagctggccaggcagctgctggacatcccttcctgcgagtatcaggccctgagagatggcttcctgaagatggtggactccgatcaggcctctgtgagctcctctaagatcaagcaggtgtactttccaatcgccgacggcgagtatcacctgctgtccctgctgacccactctggccacctgttcgagctgaggaagcgcctggacgccctgaggtttggcgatgccgtgaaggaggcccgggagtgtaagaagaccaaccacttccacccagccggctaccaggagatcttcggcctgaccacaatcggctttggcggcacaaagccccagaacatcagcgtgctgaacaatcagaatgcaggcaaggcacacctgctggcctccatcccccctgagctgacccctcgggacatcagactgccaaagacagatttctttaaggagtccttcaacgcctggcaggccaaggaggtgctggagtctctgcacagactgtttcagaccgactgcaacaatatcaatctgagggacggccgcgattacagaatccagcagtatgtggacctggtcatcgagaagatgtggcaggtgaggctgttcctggaggcctacagcggcgagctgagctccgccctgcctctggagcagaagatctggctgtatccagagtttgcagagcagaggcagcaggaggacgagtggctggataagatcatccgccacatcgcccggggcctgatcaaccactacagccggtccaaagtgatcaccaatcctgtgacactggccgaccaggagctgctggccatcgaggaggtggtggcctccaacaaggagaatctgagataa

SEQ ID NO: 288 - DNA, 888 bp, Vibrio cholerae strain L15
  misc_feature (1)..(888): Cas5
atgaatgtgctgatcctgcctcacctgaagatccacaacgccaatgccctgtctagcccctttaccgtgggcttccctgccatgacagcatggctgggattcgtgcacgccctggagagaaagctgtcccaggccggcctgtctgatctgatgctgcacagcaccgcagtggtgtcccacaggtgcgacgtgcagacacacaagggcgagggcgatttcgtgcacagcatcatcggcaccgccaaccccctggacaaggatggcagccgctccgcctttatcgaggaggcccggtgtcacctggacgtgagcctggtcatcgagtggtccggcaatgaggagcaggtgcagcagcctgagtttaccgagcagctgcaggccgtgatcgccacaatgaaggtggcaggaggcgatgtgctggccgtgggcaagccttccgtgaagtctgtgatcaccgaggacgatacaggcagggtgctgaggcagctgatgccaggatacgtgctgatcgagcggagagacctgatgatcgatgccatgcagcagggcgacgatgcaatcgacgccctgctgggctatctgaccgtgcaccaccactgcgagcagctggaggatcagtctgtggtgtggcacagccagcggaagacctccggctggatcgtgcccatcgccacaggcttccagggcatctcccctctgggcgaggccaagaaccagagagaccctagcgtgccacacaggttcgcagagtccgtggtgaccctgggagagtttgtgatggtgcacaagatcaagcacctggacgatatcctgtggcagtaccacccagacctggagaacgatctgtatctgtgccagaaggtgaacgccatcaatgagcaccagtaa

SEQ ID NO: 289 - DNA, 1032 bp, Vibrio cholerae strain L15
  misc_feature (1)..(1032): Cas7
atggccaagaacaatgacatcgcctctgtgctggccttcgagaagaagctggtgcctagcgatggctacctgtttggctgccagtgggagaccaaggagcaggccaccccactgacactgcaggagaagagcgtgagaggcacaatctccaacaggctgaaggccgccgtgcagaacgaccctgccaagctgaatgccgaggtggagaaggccaatctgcagcgggtggatgcctgtgcactgggacaggaccacgataccctgaagctgcacttcacactgaaggtgctgggaggcctggcccagccatctgcctgcaacaatgccctgtttaagcagtcttacagcaccgccgtgagccagtacatcacaaagtatggctgtttcgagctggccaagagatatgccaccaacctggccaatgccaggtttctgtggcggaacagagtgggcgccgaggagatcgaggtgcaggtgaaggccctgaacaagggcgccgagcagacctggaccttcaacgccaagcagttctctaccaggcactttgaccacaacgatagccagctgaattccctggccgacaggatcgcacaggccctggccagcgagacagaccacctgatgctgcagatcgattgctacgccaaagtgggcaaggcccaggaggtgtatccctccgaggagctggtgctggataagggcaacagcaagaccaagaagtccaagatcctgtacgccgtgaacgagcacgccgccatgcactctcagaagatcggcaatgccctgcgcagcatcgacacatggtaccctgattatgcctctgaggagcagagcgccggagcaatcgcaatcgagccctacggcgccgtgaccaatctgggcaaggccttcagaacccctaaggacaagcaggacttctacaccttctttgacaagtgggcaaggggagagagcctgcctagggaggaggatgagcactacgtgatggccgtgctggtgcggggaggcgtgttcggagagtccgacaagtaa

SEQ ID NO: 290 - DNA, 639 bp, Vibrio cholerae strain L15
  misc_feature (1)..(639): Cas6
atgaattactatcaggagatcacactgctgcccgacgcagatatcgccctgggcttcctgtggcagaacgtgtttcagcaggtgcacatcgccctggtggagcacaaggtggcctctaatcagagcctggtggccgtgggcttccctgactacagacaggccaagtttccactgggcgccaagctgaggctgttcgccaaggagcaggtgaccctggagaagctggacatccacagatggctgacaaggctggaggattacgtgcacatcaagggcgtgaagccagtgccctctgacgtgacctatgtgagctttgtgagaaagcaggtgaagtcccccgagcggatcgagagagatatgcagcagaaggccgagctgtgggccgccaagtctggcaagcctctggtggagtgcctggtggacctgcagcagtccaagcccaccgccctgtgctctctgcctttcatctacctgcacagccagcagacaaagcagaggtctccagagaagaacagcaagtttcccctgttcatcgagatgcagcagcagtccacatctcaggacggcggcttcgattgctatggcctgagctccaaggccaatggccagagcatgctggccaccgtgccacacttttaa

SEQ ID NO: 291 - protein, 420 aa, Vibrio cholerae strain L15
  misc_feature (1)..(420): Cas8
MIDPVIAAFFAERKEAWLKKNISAAMSDAEVLEKQQECEQNFLLDNWLPDAAKRAGQISVASHPCTFSHPSARKNKNGYVSSIIAKNKPRIDGFLRSGNVSVEPDALGNAAALDVYKFLSLEMSDQRSLLVHIEQESELARQLLDIPSCEYQALRDGFLKMVDSDQASVSSSKIKQVYFPIADGEYHLLSLLTHSGHLFELRKRLDALRFGDAVKEARECKKTNHFHPAGYQEIFGLTTIGFGGTKPQNISVLNNQNAGKAHLLASIPPELTPRDIRLPKTDFFKESFNAWQAKEVLESLHRLFQTDCNNINLRDGRDYRIQQYVDLVIEKMWQVRLFLEAYSGELSSALPLEQKIWLYPEFAEQRQQEDEWLDKIIRHIARGLINHYSRSKVITNPVTLADQELLAIEEVVASNKENLR

SEQ ID NO: 292 - protein, 295 aa, Vibrio cholerae strain L15
  misc_feature (1)..(295): Cas5
MNVLILPHLKIHNANALSSPFTVGFPAMTAWLGFVHALERKLSQAGLSDLMLHSTAVVSHRCDVQTHKGEGDFVHSIIGTANPLDKDGSRSAFIEEARCHLDVSLVIEWSGNEEQVQQPEFTEQLQAVIATMKVAGGDVLAVGKPSVKSVITEDDTGRVLRQLMPGYVLIERRDLMIDAMQQGDDAIDALLGYLTVHHHCEQLEDQSVVWHSQRKTSGWIVPIATGFQGISPLGEAKNQRDPSVPHRFAESVVTLGEFVMVHKIKHLDDILWQYHPDLENDLYLCQKVNAINEHQ

SEQ ID NO: 293 - protein, 343 aa, Vibrio cholerae strain L15
  misc_feature (1)..(343): Cas7
MAKNNDIASVLAFEKKLVPSDGYLFGCQWETKEQATPLTLQEKSVRGTISNRLKAAVQNDPAKLNAEVEKANLQRVDACALGQDHDTLKLHFTLKVLGGLAQPSACNNALFKQSYSTAVSQYITKYGCFELAKRYATNLANARFLWRNRVGAEEIEVQVKALNKGAEQTWTFNAKQFSTRHFDHNDSQLNSLADRIAQALASETDHLMLQIDCYAKVGKAQEVYPSEELVLDKGNSKTKKSKILYAVNEHAAMHSQKIGNALRSIDTWYPDYASEEQSAGAIAIEPYGAVTNLGKAFRTPKDKQDFYTFFDKWARGESLPREEDEHYVMAVLVRGGVFGESDK

SEQ ID NO: 294 - protein, 212 aa, Vibrio cholerae strain L15
  misc_feature (1)..(212): Cas6
MNYYQEITLLPDADIALGFLWQNVFQQVHIALVEHKVASNQSLVAVGFPDYRQAKFPLGAKLRLFAKEQVTLEKLDIHRWLTRLEDYVHIKGVKPVPSDVTYVSFVRKQVKSPERIERDMQQKAELWAAKSGKPLVECLVDLQQSKPTALCSLPFIYLHSQQTKQRSPEKNSKFPLFIEMQQQSTSQDGGFDCYGLSSKANGQSMLATVPHF

SEQ ID NO: 295 - DNA, 88 bp, Vibrio cholerae strain L15
  misc_feature (1)..(88): CRISPR
gttcactgccgtacaggcagcttagaaaaatatgcaggggtttgaaacgctcgatgttatgttcactgccgtacaggcagcttagaaa

SEQ ID NO: 296 - DNA, 1314 bp, Klebsiella oxytoca strain ICU1-2b
  misc_feature (1)..(1314): Cas8
atgacaaccgaagcactgactcacttcatcatcgactacatcgcttcacgaaagcagcccaaattagacgcctttgaaaaagaggcggcgaaacggttggctcaaggcgaggatgctggcgctatcgcgcaggagcgtcaggagcttgaagtgaagtatcagccgcgcaactggctgacggatgcggcaagacgtgctgggcaaatcagccttgtcactcatgcggcgaagtttacccacggtgactcaaaaagcagcagcatttaccgcgaaacggtgggcgatgagggctatttaagtacagctgtgctggctaacgtggcggcggatgcggtgggcaacgcggctgctctggacgtggcaaaactgctgcaaaccgaagtgggcggcgattcgctgctggcctgcctgaaacgcggcgatcgtagtccgctgatgggctttgctgaaaacgacgcccagctggcactgtggatggaaggattctctcaggcgttaacgcctgctcaacccacctcgcataagcttgccaaacagatttactttccagtcgatggcggctatcacctgctatctccgctatttgcctcctcgctggcgcaggcgatgcatgaaaaaatggtggcagcacgatttggcgaacaagcaaaagccgcgcgtgaagctcgccgggcgggtaaatggcatgcgcagcccgatgtgcgctatccgaatgttgccgaaatgcattttggcggcactaaaccgcagaatatttcggcgttaaacagctcgcgcggtgggcgggtctggctgctgccgtcgcagccgccaaaatggacaatgctcgataaggcgccgcaaaatctgactagtctctttgcactacgcggcgattttaaccgagcggcaaccgacactgtttcccggatggtttctctacttaaagagaagactgataacaataatcgccatatccgcaacgctcgggcgggttatgttgatgaactgattgatttgttatttcttcatgcagcgacgtaccagcaggaagcgtggcagggatggacgcttaacagcccggatttacctctccaccagcagctttggctcgatccctggcgtagcaaaacagacgagacattccgctctgagcgtgaaaaaggcgactggcaacgaagcgtcgcggatgacttcgcgcgctggctgaactatcgcctgaataaagcgcgtctcgatgtggggatcgccgagcgccgtgagtggcaaactcagcgtctgtttagtcaacggatgcgggaaatggaagctattgtgcaggaggcgctgaaatga

SEQ ID NO: 297 - DNA, 936 bp, Klebsiella oxytoca strain ICU1-2b
  misc_feature (1)..(936): Cas5
atgagctatctgcttttattgccccatattcgcatcgaaaacgcaaatgcggtggcaggattaacctggggattccccgctattacccactttttagggtatgttcatgcgctttcccgcagggtgagcgaatttggcgtctctttcaccggctgcgcggtgattaatcatgaacaccatattcaggcctattcctccgggcgcgactatcaatttgcgctgactcgtaatccgctgaccaaagaaggtaaaaccgctgcctttaacgaagaggggcgaatgcatcttaccgtctctttgcttgttgaatgccagggcgaaatcatcaatggcgaatatggcaaagcggcgctctgttcgtctctgcttacgctctgccagagccacaaactggcgggcggaagtatcgtgatgatgcgtgagccacagatatttaatgcgcctgatgatgaaagaacgctgcgtaagatcctctggcgtctgatgccgggttttgcactctgcgatcgcagcgagtggttgatggagcactatcgccagctgcagcagcggaggccggaaagcagcttactggatgcgtggcttgacttcgcggcgatcaaatatcagcccgttcagcaggaaccggaggatagcatgagctgggagtatcagccgaaaccgaagccggggtatctggtgccgctgatgtgcggatatcaacgtatttcccgactataccagccgggagaagtggccaacgttcgcgataccacaacgccgttcgcctttaccgaggccgtttatggcgttggagaatggcgtgggttacatcgtatagctgaccttgagccgcttatctggcgctaccgcacgagcgatacaggctactactgttctgcaatgcctgttgctgatgatgattttatatttaacgaagatgacgatttagaataa

SEQ ID NO: 298 - DNA, 1002 bp, Klebsiella oxytoca strain ICU1-2b
  misc_feature (1)..(1002): Cas7
atggcaaaggctcctgtatctgtaaaaacggcttccgtactggcatttgaacgcaagctcgccacctccgatgcgatgatgtatgcggggaactggctgggcgatagctggcaaccgatcgaaattaaggaaaaagcggtacgtggaactatctcgaaccggcttaaaaatgccatcgccagcgatgcaacaaagctggatgccgagatccaaaaagcgaatctgcaacgagtggatacggcggcgttgcccgctgatgccgacaccttaaaagtcgtattcaccctgcgggtgctggggaacttagcgacgccatcggtctgtaatgatatggcctatcagaatgcgattcagcagacgatcgaaggttatatcagcgagcacggttttgccgaactggctcgtcgctatgcggctaacctcgcaaatgggcgttttctatggcgcaaccgcattggcgctgagcagattcaggttagcgtgagcgcgcaggggcaggcgtgggtattcaatggccacgattattcattacgtgaattctctcaggacgatgaggaaatagcctcccttgcggcgctgatcgaacaggggctaagtggccaggcgtgggtgatgctaacggttgaggcgcaggtacgtttgggcgccgggcaggaggtctttccgtcacaggagctggtactggatagcaacagtagtaaaagtcgcgtgctgtatcaggtcgcgggcatcgccgggatccactcgcagaagatcggcaatgcgctgcgcactatcgatacctggcatccaaaagttgatgagctgggggcgattgcggtagagccgtacggctcggtaaccagccgcggtatggcctgtcgtcagccgaaggacaagatggatttttataccctgctggatagctgggtgacgaaaggcattaagccagacgtcgaacagcagcattatgtcatggcggttcttatccggggtggtgtattcggtgagaaaagcgaataa

SEQ ID NO: 299 - DNA, 555 bp, Klebsiella oxytoca strain ICU1-2b
  misc_feature (1)..(555): Cas6
atggactatttcctggatattcgcgttctgcctgacccggaatttagcgaagagatgcttatggccgcactgtttgccaaactgcaccgcgctttaggagccagaggcaagggggatattggcgtcagttttcctgagttttccgtcaagccggggccattattacgtttacatggtgatgaatctgcactgtgcgcgctggaagaaacgctctggcgtaaagggctgaatgattattgtcagagtgggcagataatgccggtagaggaaataaaaggatggcgttgcgtcagtcgggtacaggtaaaaagcagccccgagcggctgatgcgccgctcggtgagaaaaggctggctgacacaggatgaagcaaatgagcgattgcttagcatgcggggagagtcgacagcgctcccctggttgaatatgaaaagcctctcaaatgggcagaagtttccgctatttatttgtcacggtgagctgctggcgcagcgcgtcgcgggaacattcaatagctatgggctgagccatatcgcgactatcccctggttttag

SEQ ID NO: 300 - DNA, 1314 bp, Klebsiella oxytoca strain ICU1-2b
  misc_feature (1)..(1314): Cas8
atgacaaccgaggccctgacacactttatcatcgactacatcgcctcccggaagcagccaaagctggatgccttcgagaaggaggccgccaagagactggcccagggagaggacgcaggagcaatcgcccaggagaggcaggagctggaggtgaagtatcagccaaggaactggctgaccgatgcagcaaggagggcaggacagatcagcctggtgacccacgccgccaagttcacacacggcgactccaagtcctctagcatctacagagagaccgtgggcgatgagggctatctgtccacagccgtgctggccaatgtggcagcagacgcagtgggaaacgcagccgccctggatgtggcaaagctgctgcagacagaagtgggaggcgacagcctgctggcctgtctgaagaggggcgatcgctccccactgatgggctttgccgagaatgacgcacagctggccctgtggatggagggcttctcccaggccctgaccccagcccagcctacatctcacaagctggccaagcagatctactttcctgtggatggcggctatcacctgctgagcccactgttcgcctcctctctggcccaggccatgcacgagaagatggtggcagcaaggtttggagagcaggcaaaggcagcaagagaggcaaggagagccggcaagtggcacgcacagccagacgtgcgctaccctaacgtggccgagatgcacttcggcggcaccaagccccagaatatctccgccctgaacagctcccggggaggcagagtgtggctgctgccctctcagccccctaagtggaccatgctggacaaggcccctcagaatctgacaagcctgtttgccctgagaggcgacttcaacagggccgccacagataccgtgagccggatggtgtccctgctgaaggagaagacagataacaataacaggcacatccgcaatgcaagggcaggatacgtggacgagctgatcgatctgctgtttctgcacgccgccacctatcagcaggaggcctggcagggctggacactgaactccccagacctgccactgcaccagcagctgtggctggacccctggaggtccaagacagatgagacctttagatctgagagggagaagggcgactggcagcgcagcgtggcagacgatttcgcaaggtggctgaattaccggctgaacaaggccagactggatgtgggaatcgcagagaggagggagtggcagacccagcggctgttcagccagcggatgagagagatggaggccatcgtgcaggaggccctgaagtaa

SEQ ID NO: 301 - DNA, 936 bp, Klebsiella oxytoca strain ICU1-2b
  misc_feature (1)..(936): Cas5
atgtcttacctgctgctgctgccccacatccgcatcgagaatgcaaacgcagtggcaggactgacctggggatttcctgccatcacacacttcctgggctatgtgcacgccctgtcccggagagtgtctgagtttggcgtgtccttcaccggctgcgccgtgatcaatcacgagcaccacatccaggcctactcctctggccgggactatcagtttgccctgacaagaaatcctctgaccaaggagggcaagacagccgccttcaacgaggagggcagaatgcacctgaccgtgagcctgctggtggagtgtcagggcgagatcatcaatggagagtacggcaaggccgccctgtgcagctccctgctgaccctgtgccagagccacaagctggccggaggctccatcgtgatgatgagggagccacagatctttaacgcccccgacgatgagaggaccctgcgcaagatcctgtggaggctgatgccaggattcgcactgtgcgataggtccgagtggctgatggagcactacaggcagctgcagcagaggcgccctgagtctagcctgctggacgcctggctggatttcgccgccatcaagtatcagcctgtgcagcaggagccagaggacagcatgtcctgggagtaccagcccaagcctaagccaggctatctggtgcccctgatgtgcggctaccagcggatcagcagactgtatcagccaggcgaggtggccaacgtgagggataccacaacccccttcgcctttaccgaggccgtgtacggagtgggagagtggagaggactgcacaggatcgccgacctggagccactgatctggaggtatcgcacatctgataccggctactattgcagcgccatgcccgtggccgacgatgacttcatctttaatgaggatgacgatctggagtaa

SEQ ID NO: 302 - DNA, 1002 bp, Klebsiella oxytoca strain ICU1-2b
  misc_feature (1)..(1002): Cas7
atggcaaaggcacccgtgtctgtgaagaccgccagcgtgctggcctttgagaggaagctggccacatccgacgccatgatgtacgccggcaactggctgggcgattcttggcagcctatcgagatcaaggagaaggccgtgaggggcaccatcagcaatcgcctgaagaacgccatcgcctccgacgccacaaagctggatgccgagatccagaaggcaaatctgcagcgggtggacaccgccgccctgccagccgacgccgataccctgaaggtggtgttcacactgagagtgctgggaaacctggcaaccccaagcgtgtgcaatgatatggcctaccagaacgccatccagcagacaatcgagggctatatcagcgagcacggatttgcagagctggcccggagatacgccgccaatctggccaacggcagattcctgtggcggaatagaatcggcgccgagcagatccaggtgtctgtgagcgcccagggacaggcctgggtgtttaacggccacgactattccctgagggagttctctcaggacgatgaggagatcgcctctctggccgccctgatcgagcagggactgagcggccaggcctgggtcatgctgaccgtggaggcacaggtgcggctgggagcaggccaggaggtgtttccatctcaggagctggtgctggatagcaatagctccaagtcccgcgtgctgtaccaggtggcaggaatcgcaggcatccacagccagaagatcggcaacgccctgcggacaatcgacacctggcaccccaaggtggatgagctgggagcaatcgcagtggagccttacggcagcgtgacctcccgcggaatggcatgcaggcagcccaaggacaagatggacttctacaccctgctggactcctgggtgacaaagggcatcaagcctgatgtggagcagcagcactacgtgatggccgtgctgatcaggggaggcgtgttcggcgagaagtctgagtaa

SEQ ID NO: 303 - DNA, 555 bp, Klebsiella oxytoca strain ICU1-2b
  misc_feature (1)..(555): Cas6
atggactacttcctggatatcagagtgctgccagaccccgagttttccgaggagatgctgatggccgccctgttcgccaagctgcacagagccctgggagcaaggggcaagggcgatatcggcgtgtcttttccagagttcagcgtgaagcctggaccactgctgaggctgcacggcgacgagtccgccctgtgcgccctggaggagaccctgtggagaaagggcctgaatgattattgtcagtctggccagatcatgcctgtggaggagatcaagggatggagatgcgtgagccgggtgcaggtgaagtctagcccagagaggctgatgaggcgcagcgtgcgcaagggatggctgacccaggacgaggcaaacgagcgcctgctgtccatgaggggagagtctacagccctgccttggctgaatatgaagtccctgtctaacggccagaagtttccactgttcatctgccacggagagctgctggcccagcgcgtggcaggcacctttaattcttacggcctgagccacatcgccacaatcccttggttctaa

SEQ ID NO: 304 - protein, 437 aa, Klebsiella oxytoca strain ICU1-2b
  misc_feature (1)..(437): Cas8
MTTEALTHFIIDYIASRKQPKLDAFEKEAAKRLAQGEDAGAIAQERQELEVKYQPRNWLTDAARRAGQISLVTHAAKFTHGDSKSSSIYRETVGDEGYLSTAVLANVAADAVGNAAALDVAKLLQTEVGGDSLLACLKRGDRSPLMGFAENDAQLALWMEGFSQALTPAQPTSHKLAKQIYFPVDGGYHLLSPLFASSLAQAMHEKMVAARFGEQAKAAREARRAGKWHAQPDVRYPNVAEMHFGGTKPQNISALNSSRGGRVWLLPSQPPKWTMLDKAPQNLTSLFALRGDFNRAATDTVSRMVSLLKEKTDNNNRHIRNARAGYVDELIDLLFLHAATYQQEAWQGWTLNSPDLPLHQQLWLDPWRSKTDETFRSEREKGDWQRSVADDFARWLNYRLNKARLDVGIAERREWQTQRLFSQRMREMEAIVQEALK

SEQ ID NO: 305 - protein, 311 aa, Klebsiella oxytoca strain ICU1-2b
  misc_feature (1)..(311): Cas5
MSYLLLLPHIRIENANAVAGLTWGFPAITHFLGYVHALSRRVSEFGVSFTGCAVINHEHHIQAYSSGRDYQFALTRNPLTKEGKTAAFNEEGRMHLTVSLLVECQGEIINGEYGKAALCSSLLTLCQSHKLAGGSIVMMREPQIFNAPDDERTLRKILWRLMPGFALCDRSEWLMEHYRQLQQRRPESSLLDAWLDFAAIKYQPVQQEPEDSMSWEYQPKPKPGYLVPLMCGYQRISRLYQPGEVANVRDTTTPFAFTEAVYGVGEWRGLHRIADLEPLIWRYRTSDTGYYCSAMPVADDDFIFNEDDDLE

SEQ ID NO: 306 - protein, 333 aa, Klebsiella oxytoca strain ICU1-2b
  misc_feature (1)..(333): Cas7
MAKAPVSVKTASVLAFERKLATSDAMMYAGNWLGDSWQPIEIKEKAVRGTISNRLKNAIASDATKLDAEIQKANLQRVDTAALPADADTLKVVFTLRVLGNLATPSVCNDMAYQNAIQQTIEGYISEHGFAELARRYAANLANGRFLWRNRIGAEQIQVSVSAQGQAWVFNGHDYSLREFSQDDEEIASLAALIEQGLSGQAWVMLTVEAQVRLGAGQEVFPSQELVLDSNSSKSRVLYQVAGIAGIHSQKIGNALRTIDTWHPKVDELGAIAVEPYGSVTSRGMACRQPKDKMDFYTLLDSWVTKGIKPDVEQQHYVMAVLIRGGVFGEKSE

SEQ ID NO: 307 - protein, 184 aa, Klebsiella oxytoca strain ICU1-2b
  misc_feature (1)..(184): Cas6
MDYFLDIRVLPDPEFSEEMLMAALFAKLHRALGARGKGDIGVSFPEFSVKPGPLLRLHGDESALCALEETLWRKGLNDYCQSGQIMPVEEIKGWRCVSRVQVKSSPERLMRRSVRKGWLTQDEANERLLSMRGESTALPWLNMKSLSNGQKFPLFICHGELLAQRVAGTFNSYGLSHIATIPWF

SEQ ID NO: 308 - DNA, 88 bp, Klebsiella oxytoca strain ICU1-2b
  misc_feature (1)..(88): CRISPR
gttcactgccgtacaggcagcttagaaaaaaaactgagcggccgcagaatgaagttgtaagttcactgccgtacaggcagcttagaaa

SEQ ID NO: 309 - DNA, 1305 bp, Pseudomonas aeruginosa UCBPP-PA14
  misc_feature (1)..(1305): Cas8
atgacctctcccctcccaacgcctacgtggcaggagcttcgccagttcatcgaatccttcatccaggagcgcctccagggcaagctggacaaactccaacccgacgaagacgacaagcgccagacattgctggccacccaccggcgggaggcctggctggccgatgccgcccggcgggttggccagttgcagttggtgacccacacgctcaagccgatccatcccgacgcccgcggcagcaacctgcacagcctgccgcaagcacccggccaaccgggcctcgccggttcccatgagctaggtgacaggctggtcagcgatgtggtgggcaatgccgcggcgctggacgtattcaagtttctcagtctccagtatcagggtaaaaatcttctgaactggctgacagaagacagtgccgaggcattacaggcgctgtccgataacgccgaacaggctcgcgaatggcggcaagcgttcatcggcatcacgaccgtcaaaggcgctcccgcgtcccacagcctggccaagcagttgtactttcccctgcccggttccggctaccacctgctagcaccgctgtttcccaccagtctggtgcatcacgtccacgctctgctccgcgaagcgcgcttcggcgacgcggccaaggcggcacgcgaagcgcgcagccgccaggagtcatggccccacggattcagcgagtaccccaacctggcgatccagaagttcggcggtaccaagccgcagaacatcagtcagttgaacaacgagcgccgtggcgagaactggttgctgccatcgcttccgccgaactggcaaaggcagaatgtaaacgcgccgatgcggcactcttcggtcttcgagcatgacttcggaagaactcctgaagtatcccgcctaacccgtaccctgcagcgttttcttgccaagacagtccataacaacctcgccatccgccagcggcgtgcccaattggtggcgcaaatctgcgacgaagccctgcaatacgccgcccgtctgcgcgaactggagcccggctggagcgcaacccccgggtgccaactgcatgacgcggagcagctctggctcgatccgttgcgcgcacagaccgatgagacgttcttgcagcgccgactacgaggtgactggcctgccgaggtcggaaatcgcttcgccaactggctgaaccgggcggtcagcagcgacagtcagatactgggtagcccggaagccgcccaatggagccaggagctgagcaaggaactgacgatgttcaaggagatactcgaagatgagcgtgactga

SEQ ID NO: 310 - DNA, 984 bp, Pseudomonas aeruginosa UCBPP-PA14
  misc_feature (1)..(984): Cas5
atgagcgtgactgatcccgaggcgctgctgttgctgccacgcctgtccatccagaacgccaacgccatttccagccccttgacctggggtttcccttcgcccggcgctttcaccggattcgtccatgccttgcagcgtcgagtcggaatctccctcgatatcgaactggacggtgtcggcatcgtctgtcaccgcttcgaagcgcagatatcgcaaccggccggcaagcgcaccaaggtcttcaacctgacccgcaatccgctgaaccgcgacggctccaccgcagccatcgtcgaagaaggtcgcgcccatctggaggtcagtctgctgctcggagtgcatggcgatggtctggacgatcaccccgcacaggaaatcgccaggcaggtacaggagcaggctggcgccatgcgcctcgccggtggcagcatcctgccctggtgcaatgagcgcttcccggctccgaacgccgaactgctgatgctgggtggcagcgacgaacagcggcgcaagaaccagcgccggcttacccgccgcctgctccccggcttcgccctggtgagtcgcgaggcgttgttgcaacaacatctggaaaccttgcgcaccacgctccccgaagccaccacgctcgatgcactgctcgatctttgtcgaatcaacttcgagcctcctgcaacctcgtccgaagaagaagcatcgccgcccgatgcagcctggcaagtgcgcgacaagcccggctggctggtgccgatcccggctggctacaacgccctgtcacccctgtacctccccggcgaagtgcgaaatgcccgtgatagagaaacaccgctgcgcttcgtcgaaaacctcttcggtctgggcgaatggctcagcccccatcgcgtcgccgcgttatcggacctgctttggtatcaccacgccgagcctgacaaagggctctaccgctggagcacaccccgtttcgtcgaacacgccatcgcataa

SEQ ID NO: 311 - DNA, 1029 bp, Pseudomonas aeruginosa UCBPP-PA14
  misc_feature (1)..(1029): Cas7
atgtccaagccaatactgagcaccgcttccgtcctcgccttcgaacgtaagctcgacccttccgacgcccttatgagcgctggcgcctgggcgcaacgcgacgcctcgcaggaatggccggccgtgaccgtgcgcgagaagtccgtacgcggcaccatctccaaccgcctcaagaccaaggaccgtgacccggccaagctggacgcctcgatccagtcgcccaacctgcagacggtggacgtggccaacctgccgagcgacgccgacaccctcaaggtccgcttcaccctccgtgtgctcggcggcgccggaacaccgtctgcctgcaacgacgcggcctaccgtgacaagctgctgcaaacggtcgccacctacgtgaacgatcagggcttcgccgagctggctcgtcgttatgcgcacaacctggccaacgcccgcttcctgtggcgcaaccgggtgggcgcggaagcggtggaagtccgtatcaaccatatccgccagggcgaggtggctcgcgcctggcgcttcgacgccctggccatcggcttgcgcgacttcaaggccgacgccgaactggacgcgctcgccgaactgatcgccagcggtctctcaggcagtgggcatgtcctgctcgaagtggtcgccttcgcccgtatcggcgacggccaggaagtcttcccctcccaggaactgatcctcgacaaaggcgacaagaaaggccagaagagcaagaccctgtacagcgtacgcgatgccgcggccatccactcgcagaagatcggcaatgccctgcgcaccatcgatacgtggtatcccgacgaagatggcctcggccccatcgccgtggagccctacggctccgtcacatcccagggcaaagcctatcgccagcccaagcagaagctggacttctatacgctgctcgacaactgggtactgcgcgacgaggcgcccgccgtggagcaacagcattatgtgatcgccaacctgatccgtggcggcgtgttcggtgaagccgaagagaagtaa

SEQ ID NO: 312 - DNA, 564 bp, Pseudomonas aeruginosa UCBPP-PA14
  misc_feature (1)..(564): Cas6
atggaccactacctcgacattcgcttgcgaccggacccggaatttcccccggcgcaactcatgagcgtgctcttcggcaagctccaccaggccctggtggcacagggcggggacaggatcggcgtgagcttccccgacctcgacgaaagccgctcccggctgggcgagcgcctgcgcattcatgcctcggcggacgaccttcgtgccctgctcgcccggccctggctggaagggttgcgggaccatctgcaattcggagaaccggcagtcgtgcctcaccccacaccgtaccgtcaggtcagtcgggttcaggcgaaaagcaatccggaacgcctgcggcggcggctcatgcgccggcacgatctgagtgaggaggaggctcggaaacgcattcccgatacggtcgcgagagccttggacctgcccttcgtcacgctacgcagccagagcaccggacagcacttccgtctcttcatccgccacgggccgttgcaggtgacggcagaggaaggaggattcacctgttacgggttgagcaaaggaggtttcgttccctggttctga

SEQ ID NO: 313 - DNA, 1305 bp, Pseudomonas aeruginosa UCBPP-PA14
  misc_feature (1)..(1305): Cas8
atgacatctcctctgccaacccccacatggcaggagctgagacagtttatcgagagcttcatccaggagaggctgcagggcaagctggataagctgcagcctgacgaggacgataagcggcagaccctgctggccacacacagaagggaggcctggctggccgatgcagcacgccgggtgggacagctgcagctggtgacccacacactgaagccaatccaccctgacgcaaggggctctaatctgcacagcctgccacaggcaccaggacagcctggcctggccggctctcacgagctgggcgataggctggtgagcgacgtggtgggaaacgcagccgccctggacgtgtttaagttcctgtccctgcagtaccagggcaagaacctgctgaattggctgaccgaggatagcgccgaggccctgcaggccctgtccgacaatgcagagcaggcaagagagtggaggcaggcctttatcggaatcaccacagtgaagggagcaccagccagccactccctggccaagcagctgtactttcctctgccaggcagcggctatcacctgctggccccactgttccccacctccctggtgcaccacgtgcacgccctgctgagggaggcaaggttcggcgacgcagccaaggccgccagagaggcacgctcccggcaggagtcttggccacacggctttagcgagtaccctaatctggccatccagaagttcggcggcaccaagccccagaacatctcccagctgaacaatgagagaaggggcgagaactggctgctgccttctctgccccctaattggcagagacagaacgtgaatgccccaatgaggcactccagcgtgttcgagcacgatttcggccgcacccctgaggtgagcagactgaccaggacactgcagcggttcctggccaagacagtgcacaacaatctggccatcagacagaggagggcacagctggtggcacagatctgcgacgaggccctgcagtacgcagcaagactgagggagctggagccaggatggtccgccaccccaggctgtcagctgcacgacgcagagcagctgtggctggaccccctgagggcacagaccgacgagacatttctgcagagaaggctgaggggcgattggccagcagaagtgggaaacaggttcgcaaactggctgaatcgggccgtgagctccgactctcagatcctgggcagccccgaggcagcacagtggagccaggagctgtccaaggagctgaccatgttcaaggagatcctggaggacgagagggattaa

SEQ ID NO: 314 - DNA, 984 bp, Pseudomonas aeruginosa UCBPP-PA14
  misc_feature (1)..(984): Cas5
atgtctgtgacagaccctgaggccctgctgctgctgccaagactgagcatccagaacgccaatgccatcagctccccactgacctggggattcccttccccaggcgcctttacaggattcgtgcacgccctgcagcgccgggtgggcatctccctggatatcgagctggacggagtgggaatcgtgtgccaccgctttgaggcccagatctctcagccagccggcaagcggaccaaggtgttcaacctgacacgcaaccccctgaatcgggatggctctaccgcagcaatcgtggaggagggaagagcacacctggaggtgagcctgctgctgggagtgcacggcgacggcctggacgatcacccagcccaggagatcgcaagacaggtgcaggagcaggcaggagcaatgaggctggccggaggctctatcctgccatggtgcaacgagaggtttcccgcccctaatgcagagctgctgatgctgggaggcagcgacgagcagagaaggaagaatcagcgccggctgaccagaaggctgctgccaggattcgcactggtgagcagagaggccctgctgcagcagcacctggagacactgaggaccacactgcctgaggcaaccaccctggacgccctgctggacctgtgcagaatcaactttgagccacctgccacctctagcgaggaggaggccagcccacccgacgcagcctggcaggtgagggataagcctggatggctggtgccaatcccagcaggatacaacgccctgtcccctctgtatctgccaggcgaggtgcgcaatgccagagatagggagacacccctgcggtttgtggagaacctgttcggcctgggcgagtggctgtctcctcacagggtggccgccctgagcgatctgctgtggtatcaccacgccgagcctgacaagggcctgtacagatggagcaccccaaggttcgtggagcacgcaatcgcataa

SEQ ID NO: 315 - DNA, 1029 bp, Pseudomonas aeruginosa UCBPP-PA14
  misc_feature (1)..(1029): Cas7
atgagcaagcccatcctgtccaccgcctctgtgctggcctttgagcggaagctggacccttctgatgccctgatgagcgccggagcatgggcacagagagatgccagccaggagtggccagccgtgacagtgagagagaagtccgtgaggggcaccatctctaaccgcctgaagacaaaggaccgggaccccgcaaagctggatgccagcatccagtcccctaacctgcagaccgtggacgtggccaatctgccaagcgacgccgataccctgaaggtgcgcttcacactgcgggtgctgggaggagcaggaacaccatccgcctgcaatgatgccgcctatagagacaagctgctgcagaccgtggccacatacgtgaacgaccagggatttgcagagctggcccggagatacgcccacaacctggccaatgccaggttcctgtggaggaacagggtgggagcagaggcagtggaggtgcgcatcaatcacatcaggcagggagaggtggcaagggcatggcggtttgatgccctggccatcggcctgagagacttcaaggcagatgcagagctggacgccctggccgagctgatcgccagcggcctgtctggcagcggccacgtgctgctggaggtggtggcctttgccaggatcggcgacggccaggaggtgttcccttcccaggagctgatcctggacaagggcgataagaagggccagaagtccaagaccctgtactctgtgcgggatgcagcagcaatccacagccagaagatcggcaatgccctgagaaccatcgacacatggtatccagacgaggatggactgggaccaatcgcagtggagccttacggctctgtgaccagccagggcaaggcctataggcagcccaagcagaagctggacttctacacactgctggacaattgggtgctgagggatgaggcacctgcagtggagcagcagcactacgtgatcgccaacctgatcaggggaggcgtgttcggagaggcagaggagaagtaa

SEQ ID NO: 316 - DNA, 564 bp, Pseudomonas aeruginosa UCBPP-PA14
  misc_feature (1)..(564): Cas6
atggatcactatctggacatcagactgaggccagatcccgagtttccacccgcccagctgatgtctgtgctgttcggcaagctgcaccaggccctggtggcacagggaggcgaccggatcggcgtgtcttttccagacctggatgagtcccgctctcggctgggagagcggctgagaatccacgccagcgccgacgatctgagagccctgctggccaggccatggctggagggactgcgcgatcacctgcagttcggagagcctgcagtggtgcctcacccaaccccctacagacaggtgtctagggtgcaggccaagagcaacccagagcggctgaggcgccggctgatgagaaggcacgacctgagcgaggaggaggcaaggaagagaatccccgacacagtggcacgcgccctggatctgccctttgtgaccctgcggagccagtccacaggccagcactttcgcctgttcatcaggcacggaccactgcaggtgaccgcagaggagggaggcttcacatgctatggcctgtccaagggcggctttgtgccttggttctaa

SEQ ID NO: 317 - protein, 434 aa, Pseudomonas aeruginosa UCBPP-PA14
  misc_feature (1)..(434): Cas8
MTSPLPTPTWQELRQFIESFIQERLQGKLDKLQPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGDAAKAAREARSRQESWPHGFSEYPNLAIQKFGGTKPQNISQLNNERRGENWLLPSLPPNWQRQNVNAPMRHSSVFEHDFGRTPEVSRLTRTLQRFLAKTVHNNLAIRQRRAQLVAQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 318 - protein, 327 aa, Pseudomonas aeruginosa UCBPP-PA14
  misc_feature (1)..(327): Cas5
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRAHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVAALSDLLWYHHAEPDKGLYRWSTPRFVEHAIA

SEQ ID NO: 319 - protein, 342 aa, Pseudomonas aeruginosa UCBPP-PA14
  misc_feature (1)..(342): Cas7
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNDQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 320 - protein, 187 aa, Pseudomonas aeruginosa UCBPP-PA14
  misc_feature (1)..(187): Cas6
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARALDLPFVTLRSQSTGQHFRLFIRHGPLQVTAEEGGFTCYGLSKGGFVPWF

SEQ ID NO: 321 - DNA, 88 bp, Pseudomonas aeruginosa UCBPP-PA14
  misc_feature (1)..(88): CRISPR
gttcactgccgtgtaggcagctaagaaaaccacccgctaccaccggcagccgcaccggccgttcactgccgtgtaggcagctaagaaa

SEQ ID NO: 322 - DNA, 948 bp, Shewanella putrefaciens CN-32
  misc_feature (1)..(948): Cas7
atgcaaaaagtaacgggaattaaaagtgttgattttaaaattaaagcattaggtcatggcgtagtgaattggaatgggcctacaaccttaaccggtgatgacggtaaaacggttgataatcataccttgccaaaattgcgtggctacacaaacttgaccggtaaagtgaaagatgaaacgggctataaatataaaaaacaagcaactgacattaatttcaaagaaacgccactgtatataagtcaaaattgcattcgccatcatttatttcgtgaacaagcattcgatttacattatgccagtgacaaaaacctcaaaaatgtcctggcttcaattacagggttgatccgtggttacgtagtgccctcaagtcaatgcaaacgcaccagtccgctattgttggaagattttgttgatcaattgggtaacggcaattttgaacaatatgggcaggcaggagcaagagatagtacatcatttttttcaaagaccacttttggggatacagaatacatctcctatggctctattagtattgaacagttgcagtttatatcgttggataagaagtttgatcgtgctgcaatggttatcaaagaaggagagggcgaggttattgccgctgaactacagaattatattcagtcacttaaccccagcttaaatccacaagccatttttcattcaaactacgtcagaagaggcactatattcgaagagggagaatgcggcattttacttaatgatgatgcagtaaaagccttggttgctgaaacattagaacgcttagctaatttgtctattcgccaagctaaaggttatatgtacgtggatgacatcacggtggattacaacgacagccataaaatgatgcgtatcaagcgtgatgagtcagaaatcatcaatgagcagcatgcgccatttgcacagtatttttatgcaaaatag

SEQ ID NO: 323 - DNA, 1011 bp, Shewanella putrefaciens CN-32
  misc_feature (1)..(1011): Cas5
atgaaaataatcatagaatatgactcttgctggcgtaatgcctttttaggtggttcaaataatgaacctgtaccgaaaaaaggccgcgaatttttaggctcaatgacgagcttaaaaaaagaaggcaattttaaggtgtgtgaaaataccttagataccgtaatgggagtactaaatcgtttaattggcgaccaacgaaagctttatcaggcgcgcagtaaaatgtacgaatccgcttattacttcgaagcactggaagataaagtcagctttatagataagccgcagttgaccaatgaaatatcatttattcgtaatatgaatggcagtacggatcagaatgcatttactggaatgatcaaagtgtctgatcctgtttttacctctgaatattcacagcaattttggggcgtgttggctctcgatttcacgcagctctgtgattttattattaagcaatcacaagttgtaggatctattgagttaaacccgttaagtattatcaatcgcttggagagccttaatcaggaaaaagcactagaaaatagtgatgatttagcccaagtattaaaggtactaaatgaatactttcctgatattgaatatttaaataataaaggtttgatcacacctatcagcatttattgctcggcgctttaccttcagcttgcccgcttagaaactagctttaatatgaccacagctaaaacgaaagcaggggggattagtggaatttccaaacgaggtttcactaaaaaagacttcatggaccgatatacaacgggacccaaaaaaacaatctggggtaatccttttatcaaaaaagaaaagataaaagggcaaggtgaagtgacctccatgatgaccaaagcaagtggtcaattggaaattagtatcgatgtggatcgagacaaagcccaagaaatcaaaattttgattgaaaatgctggggtatcaagcttttaccttggaaaaaaagggctggcctatgtatcaaacattaagctttag

SEQ ID NO: 324 - DNA, 552 bp, Shewanella putrefaciens CN-32
  misc_feature (1)..(552): Cas6
atgaactcatatattgatatacggctgaagcctgatgccgaaatgcgggaggctgagctcagtagtaaagtatttactaaatttcacaaagcgttagtgacgctcaatagccataaaattggcattagctttccgcaaatgaaattaagcttagggcagttatttcgcattcatggtgatgcgagtttattgcatgatttacaaggcctggattggttaggccctttggcaggatattgtcaggttactgctgtttctgccgtgcctgatcacgtgcaatatcgtattgtttccgttaaacgcagtaatttaagtaaagcaaaattgaagcgtttaattgccagaggcagcatagataaagacggagagaaacggtacaaggtaaaaatgctcggccaaggatttgataatccatatcttgatctgtttagtagttccacagggcaggtatatcgtaaattctttgagtttagcgacattcaagctcacccccttgatggtgagtttgatagttatggtcttagcaaaaccgctacagtaccttggttttaa

SEQ ID NO: 325 - DNA, 948 bp, Shewanella putrefaciens CN-32
  misc_feature (1)..(948): Cas7
atgcagaaggtgaccggcatcaagtccgtggacttcaagatcaaggccctgggccacggcgtggtgaactggaatggccccaccacactgacaggcgacgatggcaagaccgtggacaatcacacactgcctaagctgagaggctacaccaacctgacaggcaaggtgaaggatgagaccggctacaagtataagaagcaggccaccgacatcaatttcaaggagacacctctgtacatcagccagaactgcatccggcaccacctgtttagagagcaggccttcgatctgcactatgcctctgacaagaacctgaagaatgtgctggccagcatcaccggactgatcaggggatacgtggtgccaagctcccagtgtaagcggacatcccccctgctgctggaggattttgtggaccagctgggcaacggcaatttcgagcagtacggacaggcaggagcaagggatagcacctccttctttagcaagaccacattcggcgacacagagtacatctcctatggctctatcagcatcgagcagctgcagtttatcagcctggataagaagttcgaccgcgccgccatggtcatcaaggagggagagggagaagtgatcgcagcagagctgcagaattacatccagagcctgaacccctccctgaatcctcaggccatctttcactctaactatgtgcggagaggcaccatcttcgaggagggcgagtgcggcatcctgctgaatgacgatgcagtgaaggccctggtggcagagaccctggagagactggccaacctgtccatcaggcaggccaagggctacatgtatgtggacgatatcacagtggattacaatgactctcacaagatgatgcggatcaagagagatgagagcgagatcatcaacgagcagcacgccccttttgcccagtacttctatgcaaagtaa

SEQ ID NO: 326 - DNA, 1011 bp, Shewanella putrefaciens CN-32
  misc_feature (1)..(1011): Cas5
atgaagatcatcatcgagtacgactcctgctggagaaacgccttcctgggcggctctaacaatgagcctgtgccaaagaagggcagggagtttctgggcagcatgacatccctgaagaaggagggcaacttcaaggtgtgcgagaataccctggatacagtgatgggcgtgctgaacaggctgatcggcgaccagaggaagctgtaccaggcacggtccaagatgtatgagtctgcctactattttgaggccctggaggataaggtgagcttcatcgacaagccccagctgaccaatgagatctcctttatcagaaacatgaatggctctaccgatcagaacgccttcacaggcatgatcaaggtgagcgaccccgtgttcacctctgagtacagccagcagttctggggcgtgctggccctggacttcacccagctgtgcgacttcatcatcaagcagagccaggtggtgggctccatcgagctgaaccccctgtctatcatcaataggctggagagcctgaaccaggagaaggccctggagaatagcgacgatctggcccaggtgctgaaggtgctgaacgagtactttccagacatcgagtatctgaacaataagggcctgatcacccccatcagcatctactgttccgccctgtatctgcagctggcccgcctggagacctccttcaatatgaccacagccaagacaaaggccggcggcatctccggcatctctaagagaggctttaccaagaaggatttcatggacaggtacaccacaggccccaagaagacaatctggggcaacccttttatcaagaaggagaagatcaagggccagggcgaggtgacctctatgatgacaaaggccagcggccagctggagatctccatcgacgtggatcgggacaaggcccaggagatcaagatcctgatcgagaatgccggcgtgtcctctttctacctgggcaagaagggcctggcctatgtgagcaacatcaagctgtaa

SEQ ID NO: 327 - DNA, 552 bp, Shewanella putrefaciens CN-32
  misc_feature (1)..(552): Cas6
atgaacagctatatcgatatccgcctgaagccagacgcagagatgagggaggcagagctgtctagcaaggtgtttaccaagttccacaaggccctggtgacactgaactcccacaagatcggcatctcttttccacagatgaagctgtccctgggccagctgttcagaatccacggcgatgcctctctgctgcacgatctgcagggcctggactggctgggacctctggccggatactgccaggtgaccgccgtgagcgccgtgccagaccacgtgcagtataggatcgtgtccgtgaagcggagcaatctgagcaaggccaagctgaagaggctgatcgcccgcggcagcatcgacaaggatggcgagaagcggtacaaggtgaagatgctgggccagggctttgataacccatacctggacctgttctcctctagcaccggccaggtgtatagaaagttctttgagttttccgatatccaggcccacccactggatggcgagttcgactcctatggcctgtctaagaccgcaacagtgccatggttctaa

SEQ ID NO: 328 - protein, 315 aa, Shewanella putrefaciens CN-32
  misc_feature (1)..(315): Cas7
MQKVTGIKSVDFKIKALGHGVVNWNGPTTLTGDDGKTVDNHTLPKLRGYTNLTGKVKDETGYKYKKQATDINFKETPLYISQNCIRHHLFREQAFDLHYASDKNLKNVLASITGLIRGYVVPSSQCKRTSPLLLEDFVDQLGNGNFEQYGQAGARDSTSFFSKTTFGDTEYISYGSISIEQLQFISLDKKFDRAAMVIKEGEGEVIAAELQNYIQSLNPSLNPQAIFHSNYVRRGTIFEEGECGILLNDDAVKALVAETLERLANLSIRQAKGYMYVDDITVDYNDSHKMMRIKRDESEIINEQHAPFAQYFYAK

SEQ ID NO: 329 - protein, 336 aa, Shewanella putrefaciens CN-32
  misc_feature (1)..(336): Cas5
MKIIIEYDSCWRNAFLGGSNNEPVPKKGREFLGSMTSLKKEGNFKVCENTLDTVMGVLNRLIGDQRKLYQARSKMYESAYYFEALEDKVSFIDKPQLTNEISFIRNMNGSTDQNAFTGMIKVSDPVFTSEYSQQFWGVLALDFTQLCDFIIKQSQVVGSIELNPLSIINRLESLNQEKALENSDDLAQVLKVLNEYFPDIEYLNNKGLITPISIYCSALYLQLARLETSFNMTTAKTKAGGISGISKRGFTKKDFMDRYTTGPKKTIWGNPFIKKEKIKGQGEVTSMMTKASGQLEISIDVDRDKAQEIKILIENAGVSSFYLGKKGLAYVSNIKL

SEQ ID NO: 330 - protein, 183 aa, Shewanella putrefaciens CN-32
  misc_feature (1)..(183): Cas6
MNSYIDIRLKPDAEMREAELSSKVFTKFHKALVTLNSHKIGISFPQMKLSLGQLFRIHGDASLLHDLQGLDWLGPLAGYCQVTAVSAVPDHVQYRIVSVKRSNLSKAKLKRLIARGSIDKDGEKRYKVKMLGQGFDNPYLDLFSSSTGQVYRKFFEFSDIQAHPLDGEFDSYGLSKTATVPWF

SEQ ID NO: 331 - DNA, 88 bp, Shewanella putrefaciens CN-32
  misc_feature (1)..(88): CRISPR
gttcaccgccgcacaggcggcttagaaatcaaccaaatcataaattgcgcgaccacattggttcaccgccgcacaggcggcttagaaa

SEQ ID NO: 332 - DNA, 990 bp, Acinetobacter sp. 869535
  misc_feature (1)..(990): Cas7
atggctaaagtaacaggcgtaaaaagcgtagattttaaaattacagcatatggttatggggtggtgaattggaatggtccaacgtcactgacaggtaatgatggtaagacagtggataaccacacattacctaaacttcgtggtttcagtaatttatcaggtagagtcaaagaagaaacaggctacaaataccgtaaagaagcatcagacattgattttaacgaaacgcctttatatatcagccaaaattgtattcgccatcacttattccgtgaccaatcttttgatttacattatgcaaaagataagaatttgattgatgttctagcatctattacgggattaatccgtggttatgttgtgccatcgagtcaatgtaaacgtacaagtccacttttgattactgattttattgatcagttgggtaatggcaactttgaacagctttcgaatgcaagttcaagtgaagaaattacgcaagatgatggctcaaaaacatataaacgtggtgaaaactcaatcttctctaaaacgacctttggtgataccgaatatatcgcttatggctcgattagtattgaacaattgcagttcatttcactcgataaaaaatttgaccgtgcttcgatgattattaaagaaggagaaggtgaaaagattgcagagcgagtacaggaatttattaagagccttgatccatcgaaagaaccaaaagcaattttccataaaaattatgtccgtaagggaacaatctttaatgaaggtgaagtgggtattttactcgacaacactgcaattgatattttagtcaaagaaacgctttcaatgcttgaagaactcgttattaagcaagccaaaggttatatgtgcgcagatacggtagaagtggattataacgacagtcataaaatgatgcgtattaaacgcaatccagaccaagccaatcctgagctacaacaagattatgcagtttattttgaagcccaataa

SEQ ID NO: 333 - DNA, 1014 bp, Acinetobacter sp. 869535
  misc_feature (1)..(1014): Cas5
atgcaaatcattattgaatatgaatcctcttggcgaaattcatttttagatggctctaataatgaacccttgcctaaaggcggacgtaattttattgcttcaatgacaacattaaagcaagaaggcaattacaaaaagcgtagtatttcaaaagataccgtcatgggcattctaaatcgtttgattggtgatcaacgtaaactttatcaggcacgacaggatgaaaattattattttactgaagttgaaaaagtacttcaggagaatgatattgtcgatcacgctttaaatagtaacgagatggtttatatccgtaatgtttcagggagtacagatcaaaattcatttacaggtgaaattaaagcaaatgatccatcctttagctcgagtttttcagctgaactttggggtgttttatggcttaatttatctgaagtttccaaatttattttggatgagtcatattctgtgacctactctgaagttttagatccaattacggtgtgtaatcgtattgaagttttgagtgcagaaaaaccaatggatctgacggaggatattcaagctgtactagactatttattgaatcatttccccgatacaaagtatttgactgcaaaaaagcaattacctttgatcagtatttatgcctctgctttatatcttcaaattacaagattatctcaaagatatgatctctcaactgtcttaacaaaaagtggcggactgagtggaatctcaaagcgtggatttaccaaaaaagattttatggatcgttatacgacaggaagtaaaaagctcatttggggcaatccctatttattgaaagaaaagaaaaaaggtgagggtgaaatcgtatctgttttaaccaaagctagtggaaagctcattataaatttgaatatttctaaagaacaagcaagagatttagaagaaaaaattgaaaatgcaggggtttcatctttttacttaggtaaaaagggcttggcttatgtcacggatattagaccttaa

SEQ ID NO: 334 - DNA, 603 bp, Acinetobacter sp. 869535
  misc_feature (1)..(603): Cas6
atgaactattacattgaagtaacattaatggaaaatgatcaattttctccttatgaattatggtcacaactttatcctcaattgcatcttgcattggttgaagccaaaaatgctgacaataaagtgaatattggattttcgttccctcaataccgctttcatcaagataaaggtgttggatttataggtacaaaattacgtttatttgctgagtctgaagctgatttgaagaaactggacattcgacgttggcttgagcgtttagaagattatgtacatgtcacttctattcgtgaagtacctaatgatattaagaactatgccatttataagcgtaagcaagtgaaaaccaatgcacaacgtttggcgcgtcaccgtgtaaaacgtggggatattggctttgatgaggcattagccagatacagcaatgtagttacgacaaccaacatgccttatattgaaatgaaaagcctgagcacttcagatcagcaaagtgaaaaacgttttaaattgtttatcgaaaagcaatctgctgaaaaatctgaaactcaggtttttagcacttatggattaagttcggtgtcatctgtaccagaattttaa

SEQ ID NO: 335 - DNA, 990 bp, Acinetobacter sp. 869535
  misc_feature (1)..(990): Cas7
atggccaaggtgacaggcgtgaagtccgtggacttcaagatcaccgcctacggctatggcgtggtgaactggaatggcccaacaagcctgaccggcaatgacggcaagacagtggataaccacaccctgcccaagctgagaggcttctccaatctgtctggcagggtgaaggaggagacaggctacaagtataggaaggaggcctctgacatcgacttcaacgagacccctctgtacatcagccagaactgcatcaggcaccacctgtttcgcgaccagtccttcgatctgcactatgccaaggacaagaacctgatcgatgtgctggcctctatcaccggactgatcaggggatacgtggtgccaagctcccagtgtaagcggacaagccccctgctgatcaccgacttcatcgatcagctgggcaacggcaattttgagcagctgagcaatgcctctagctccgaggagatcacacaggacgatggctccaagacctacaagcgcggcgagaacagcatcttttccaagaccacattcggcgacaccgagtacatcgcctatggctccatctctatcgagcagctgcagtttatctccctggacaagaagttcgatagagcctctatgatcatcaaggagggcgagggcgagaagatcgccgagagggtgcaggagttcatcaagagcctggaccccagcaaggagcctaaggccatcttccacaagaattacgtgcggaagggcacaatctttaacgagggcgaagtgggcatcctgctggacaatacagccatcgatatcctggtgaaggagaccctgagcatgctggaggagctggtcatcaagcaggccaagggctacatgtgcgccgacaccgtggaggtggactataacgattcccacaagatgatgaggatcaagcgcaatccagaccaggccaaccccgagctgcagcaggattacgccgtgtatttcgaggcacagtaa

SEQ ID NO: 336 - DNA, 1014 bp, Acinetobacter sp. 869535
  misc_feature (1)..(1014): Cas5
atgcagatcatcatcgagtacgagagctcctggcgcaactccttcctggacggctctaacaatgagcctctgccaaagggcggccggaacttcatcgcctccatgacaaccctgaagcaggagggcaactacaagaagcggagcatctctaaggatacagtgatgggcatcctgaacaggctgatcggcgaccagcgcaagctgtatcaggcccggcaggatgagaattactatttcaccgaggtggagaaggtgctgcaggagaacgacatcgtggatcacgccctgaacagcaatgagatggtgtacatcagaaacgtgagcggcagcacagaccagaactccttcaccggagagatcaaggccaatgatcccagcttttctagctccttctccgccgagctgtggggcgtgctgtggctgaacctgtccgaggtgtctaagtttatcctggacgagtcttacagcgtgacatattctgaggtgctggaccccatcaccgtgtgcaatcggatcgaggtgctgagcgccgagaagcctatggacctgaccgaggatatccaggccgtgctggactacctgctgaaccactttccagatacaaagtatctgaccgccaagaagcagctgcccctgatcagcatctacgcctccgccctgtatctgcagatcacacggctgtctcagagatacgacctgagcacagtgctgaccaagtccggcggactgagcggcatctccaagagaggctttaccaagaaggacttcatggataggtacacaaccggcagcaagaagctgatctggggcaatccttatctgctgaaggagaagaagaagggcgagggcgagatcgtgtctgtgctgacaaaggccagcggcaagctgatcatcaacctgaatatctccaaggagcaggccagagacctggaggagaagatcgagaacgccggcgtgtctagcttctacctgggcaagaagggcctggcctatgtgaccgatatcaggccataa

SEQ ID NO: 337 - DNA, 603 bp, Acinetobacter sp. 869535
  misc_feature (1)..(603): Cas6
atgaattactatatcgaggtgaccctgatggagaacgatcagttttctccttacgagctgtggagccagctgtatccacagctgcacctggccctggtggaggcaaagaacgccgacaataaggtgaacatcggcttctcctttccccagtaccgctttcaccaggataagggcgtgggcttcatcggcaccaagctgcggctgtttgccgagtccgaggccgacctgaagaagctggatatccggcggtggctggagagactggaggactatgtgcacgtgacatctatcagggaggtgcccaatgatatcaagaactacgccatctataagaggaagcaggtgaagaccaacgcacagcgcctggccaggcacagagtgaagcggggcgacatcggcttcgatgaggccctggcccgctacagcaatgtggtgaccacaaccaacatgccttatatcgagatgaagagcctgtccacatctgaccagcagtctgagaagcggtttaagctgttcatcgagaagcagtccgccgagaagtctgagacacaggtgttcagcacctacggcctgtctagcgtgtcctctgtgcctgagttttaa

SEQ ID NO: 338 - protein, 329 aa, Acinetobacter sp. 869535
  misc_feature (1)..(329): Cas7
MAKVTGVKSVDFKITAYGYGVVNWNGPTSLTGNDGKTVDNHTLPKLRGFSNLSGRVKEETGYKYRKEASDIDFNETPLYISQNCIRHHLFRDQSFDLHYAKDKNLIDVLASITGLIRGYVVPSSQCKRTSPLLITDFIDQLGNGNFEQLSNASSSEEITQDDGSKTYKRGENSIFSKTTFGDTEYIAYGSISIEQLQFISLDKKFDRASMIIKEGEGEKIAERVQEFIKSLDPSKEPKAIFHKNYVRKGTIFNEGEVGILLDNTAIDILVKETLSMLEELVIKQAKGYMCADTVEVDYNDSHKMMRIKRNPDQANPELQQDYAVYFEAQ

SEQ ID NO: 339 - protein, 337 aa, Acinetobacter sp. 869535
  misc_feature (1)..(337): Cas5
MQIIIEYESSWRNSFLDGSNNEPLPKGGRNFIASMTTLKQEGNYKKRSISKDTVMGILNRLIGDQRKLYQARQDENYYFTEVEKVLQENDIVDHALNSNEMVYIRNVSGSTDQNSFTGEIKANDPSFSSSFSAELWGVLWLNLSEVSKFILDESYSVTYSEVLDPITVCNRIEVLSAEKPMDLTEDIQAVLDYLLNHFPDTKYLTAKKQLPLISIYASALYLQITRLSQRYDLSTVLTKSGGLSGISKRGFTKKDFMDRYTTGSKKLIWGNPYLLKEKKKGEGEIVSVLTKASGKLIINLNISKEQARDLEEKIENAGVSSFYLGKKGLAYVTDIRP

SEQ ID NO: 340 - protein, 200 aa, Acinetobacter sp. 869535
  misc_feature (1)..(200): Cas6
MNYYIEVTLMENDQFSPYELWSQLYPQLHLALVEAKNADNKVNIGFSFPQYRFHQDKGVGFIGTKLRLFAESEADLKKLDIRRWLERLEDYVHVTSIREVPNDIKNYAIYKRKQVKTNAQRLARHRVKRGDIGFDEALARYSNVVTTTNMPYIEMKSLSTSDQQSEKRFKLFIEKQSAEKSETQVFSTYGLSSVSSVPEF

SEQ ID NO: 341 - DNA, 88 bp, Acinetobacter sp. 869535
  misc_feature (1)..(88): CRISPR
gttcactgccatataggcagcttagaaaatcgttttttcatacgagattcgaaacggacagttcactgccatataggcagcttagaaa

SEQ ID NO: 342 - DNA, 948 bp, Vibrio cholerae HE48
  misc_feature (1)..(948): Cas7
atgcaaaaagtaacaggaattaaaagtgtagattttaaaattaaagcattaggtcatggtgtagtgaattggaatgggcctacaaccttaactggagatgatggtaaaacagtcgataatcataccttgccaaaattgcgcggctataccaacttaaccggtaaagtgaaagatgaaactggctataaatataaaaaacaagcaactgacattaatttcaaagaaacaccactgtatataagtcaaaattgtattcgacatcatttgtttcgtgagcaagcttttgatttacattttgctagtgacaaaaacctaaaaaacgttctggcttcaattacggggttgatccgaggttatgtagttcctgcaagtcaatgtaagcgcaccagtccactattgttagaagattttgttgatcaattggggaatggcaactttgaacaatatggacaggcaggtgctagagatagcacatcatttttttcaaagactacttttggtgatactgaatatatctcttatggttccatcagtattgaacaactgcaatttatatcgttggataagaagtttgatcgtgccgcaatggttatcaaagagggcgagggtgaggttattgccgctgaactacaaagctatattaagtcacttaatcctagcttaaacccacaggcgatttttcacaaaaactacgtcagaagaggcacaatatttgaagagggagagtgtggcattttacttaatgatgacgcagtgaaagctttagttgacgaaacactagatcgtttagctaatttgtctattcgtcaagcgaaaggttatatgtatgttgacgaaattacagttgattataacgatagtcataaaatgatgcgcattaagcgtgatgaatcagaaatttcagagcaacctaatagcaattttgcaatttacttttatgcaaagtag

SEQ ID NO: 343 - DNA, 1056 bp, Vibrio cholerae HE48
  misc_feature (1)..(1056): Cas5
atgaaaatcttaattgattatgaagcatcttggcgtaattcatttttggatggtaataatgatgaaccattacccgcgaaaggtagaacatttatagctgcaagctccagtttaaatgatcgtgaaaagccggataattttaaattagttgacgtaacgaagcagactgtatttggaatcctgtgtcgattgatcggtgatcaaaggaaattataccaatcaaagcaaagtgatacatatttcctgaaagggttggaagactttataacgttcaaagatatacctgtgttgaccaatgaaattgtatatattcggaatatgactggcagctttgacagagagtcatatactggagtgataaatacaaatcattggttgtttaaatctgttttttctaatcaactttggagtcttgcttttactgatctaaatgcactggtcagttttatagttgaagagattgaagttgctaatgatcaagagttcgatcctagggatgttattgatcgatttaataaatttaaaagtattggtatcagtaaaattgatgaattaggcttgtcagaaaatcgtttatataaggctgttgacattctttatgatgctaaccttaatgcaaatgtaaggtctttgtttcccagtatgaaaaagagcttttctgatattgattatattaaatcagataaagttgatgtcagagcattatattgctctgcactatatttaaaattagtcaggcttaatctcggtggtatacctataccgagtaatattaaagggttttctgtggctggtttgacaccaaaagactttatgggcagtttcacacaaggtaaaaagaaggtttacggtaatccttatctaaaaaaggaaatgataaaagggcaaggagaagtgacatctatgctgaccaaagccagtgggcagttggaaattactattgacgtggatcgagacaaagcacaagaaatcaaaacgttgattgaaaatgctggggtatcaagcttttaccttggaaaaaaagggctggcttacgtttcaagcattcgactttag

SEQ ID NO: 344 - DNA, 552 bp, Vibrio cholerae HE48
  misc_feature (1)..(552): Cas6
atggacgcatacattgatatacggctgatgcctgatgctgaaatgcgcgaggcagaattaagtagtaaagtctttattaaattccacaaagcactggtgaagttacagagcaataaaattggtattagctttccagaagcaaatattaagctagggcgattatttcgtttacacggtgaagtgagcgcattgcatgatttgcaggggttaaattggttaggacctttggcaggatattgcaagattactacggttactcatgtgccagaccaagtggaatatcgcatcatttcagttaaacgcagcaatttaagcaaagcaaaattagcgcgtttaattgctagaggtagcatagataaagatggtgagaaacgttacaaagtaaaaatgcttcgccaagggtttgataatccataccttgatctgtctagcagttcaacagggcaggtgtaccgaaaattctttgagtttagtgatattcaagctgagccagttgatggtgagtttgatagttatggtctaagcaaaacagcaactgtaccttggttttaa

SEQ ID NO: 345 - DNA, 948 bp, Vibrio cholerae HE48
  misc_feature (1)..(948): Cas7
atgcagaaggtgaccggcatcaagtccgtggacttcaagatcaaggccctgggccacggcgtggtgaactggaatggccctaccacactgacaggcgacgatggcaagaccgtggataatcacacactgccaaagctgaggggctataccaacctgacaggcaaggtgaaggacgagaccggctacaagtataagaagcaggccaccgatatcaacttcaaggagacacctctgtacatcagccagaactgcatcaggcaccacctgttccgcgagcaggcctttgacctgcacttcgcctctgataagaatctgaagaacgtgctggccagcatcaccggactgatcaggggctatgtggtgccagccagccagtgtaagagaacatcccccctgctgctggaggattttgtggaccagctgggcaacggcaatttcgagcagtacggacaggcaggagcaagggactccacctctttcttttccaagaccacattcggcgatacagagtacatctcttatggcagcatctccatcgagcagctgcagtttatcagcctggacaagaagttcgatcgggccgccatggtcatcaaggagggagagggagaagtgatcgcagcagagctgcagagctacatcaagtccctgaatccatctctgaacccccaggccatctttcacaagaactatgtgcggagaggcaccatcttcgaggagggcgagtgcggcatcctgctgaatgacgatgccgtgaaggccctggtggacgagaccctggatcggctggccaacctgtccatcagacaggccaagggctacatgtatgtggacgagatcacagtggattacaatgacagccacaagatgatgcggatcaagagagatgagtctgagatcagcgagcagccaaactccaattttgccatctacttctatgcaaagtaa

SEQ ID NO: 346 - DNA, 1056 bp, Vibrio cholerae HE48
  misc_feature (1)..(1056): Cas5
atgaagatcctgatcgactacgaggcctcttggagaaacagctttctggacggcaacaatgatgagcctctgccagccaagggcaggacattcatcgccgccagctcctctctgaatgaccgcgagaagccagataactttaagctggtggatgtgaccaagcagacagtgttcggcatcctgtgcaggctgatcggcgaccagcgcaagctgtaccagtctaagcagagcgatacctattttctgaagggcctggaggactttatcaccttcaaggatatccccgtgctgacaaatgagatcgtgtacatcaggaacatgacaggctccttcgaccgcgagtcttataccggcgtgatcaacacaaatcactggctgtttaagtccgtgttctctaatcagctgtggagcctggcctttaccgacctgaacgccctggtgtccttcatcgtggaggagatcgaggtggccaatgatcaggagttcgatccccgggacgtgatcgatcggttcaacaagttcaagtccatcggcatctctaagatcgacgagctgggcctgagcgagaacaggctgtacaaggccgtggacatcctgtatgatgccaacctgaatgccaacgtgcgcagcctgtttccttccatgaagaagagcttctccgacatcgattacatcaagtctgacaaggtggatgtgcgggccctgtactgcagcgccctgtatctgaagctggtgagactgaatctgggcggcatccccatcccttctaacatcaagggctttagcgtggccggcctgaccccaaaggactttatgggctccttcacacagggcaagaagaaggtgtacggcaatccctatctgaagaaggagatgatcaagggccagggcgaggtgacctccatgctgacaaaggcctctggccagctggagatcaccatcgacgtggatagagacaaggcccaggagatcaagacactgatcgagaacgccggcgtgagctccttctacctgggcaagaagggcctggcctacgtgagcagcatcaggctgtaa

SEQ ID NO: 347 - DNA, 552 bp, Vibrio cholerae HE48
  misc_feature (1)..(552): Cas6
atggacgcctacatcgatatccggctgatgccagatgccgagatgagagaggccgagctgagctccaaggtgtttatcaagttccacaaggccctggtgaagctgcagtccaataagatcggcatctcttttcctgaggccaacatcaagctgggcaggctgttccgcctgcacggagaggtgtccgccctgcacgacctgcagggcctgaattggctgggaccactggccggctactgcaagatcaccacagtgacccacgtgcccgatcaggtggagtataggatcatctctgtgaagcggagcaacctgtctaaggcaaagctggccaggctgatcgcaagaggctccatcgacaaggatggcgagaagaggtataaggtgaagatgctgcgccagggctttgacaatccttacctggatctgtctagctcctctaccggccaggtgtatcggaagttctttgagtttagcgacatccaggcagagccagtggacggagagttcgatagctacggcctgtccaagaccgcaacagtgccttggttctaa

SEQ ID NO: 348 - protein, 315 aa, Vibrio cholerae HE48
  misc_feature (1)..(315): Cas7
MQKVTGIKSVDFKIKALGHGVVNWNGPTTLTGDDGKTVDNHTLPKLRGYTNLTGKVKDETGYKYKKQATDINFKETPLYISQNCIRHHLFREQAFDLHFASDKNLKNVLASITGLIRGYVVPASQCKRTSPLLLEDFVDQLGNGNFEQYGQAGARDSTSFFSKTTFGDTEYISYGSISIEQLQFISLDKKFDRAAMVIKEGEGEVIAAELQSYIKSLNPSLNPQAIFHKNYVRRGTIFEEGECGILLNDDAVKALVDETLDRLANLSIRQAKGYMYVDEITVDYNDSHKMMRIKRDESEISEQPNSNFAIYFYAK

SEQ ID NO: 349 - protein, 351 aa, Vibrio cholerae HE48
  misc_feature (1)..(351): Cas5
MKILIDYEASWRNSFLDGNNDEPLPAKGRTFIAASSSLNDREKPDNFKLVDVTKQTVFGILCRLIGDQRKLYQSKQSDTYFLKGLEDFITFKDIPVLTNEIVYIRNMTGSFDRESYTGVINTNHWLFKSVFSNQLWSLAFTDLNALVSFIVEEIEVANDQEFDPRDVIDRFNKFKSIGISKIDELGLSENRLYKAVDILYDANLNANVRSLFPSMKKSFSDIDYIKSDKVDVRALYCSALYLKLVRLNLGGIPIPSNIKGFSVAGLTPKDFMGSFTQGKKKVYGNPYLKKEMIKGQGEVTSMLTKASGQLEITIDVDRDKAQEIKTLIENAGVSSFYLGKKGLAYVSSIRL

SEQ ID NO: 350 - protein, 183 aa, Vibrio cholerae HE48
  misc_feature (1)..(183): Cas6
MDAYIDIRLMPDAEMREAELSSKVFIKFHKALVKLQSNKIGISFPEANIKLGRLFRLHGEVSALHDLQGLNWLGPLAGYCKITTVTHVPDQVEYRIISVKRSNLSKAKLARLIARGSIDKDGEKRYKVKMLRQGFDNPYLDLSSSSTGQVYRKFFEFSDIQAEPVDGEFDSYGLSKTATVPWF

SEQ ID NO: 351 - DNA, 88 bp, Vibrio cholerae HE48
  misc_feature (1)..(88): CRISPR
gttcactgccgcacaggcagcttagaaataaccggaggcgtacactcgatagaggcagcggttcactgccgcacaggcagcttagaaa

SEQ ID NO: 352 - DNA, 3736 bp, Artificial Sequence
  Synthetic: CRISPR
taatacgactcactataggggaattgtgagcggataacaattcccctgtagaaataattttgtttaactttaataaggagatataccatgggctagcgagttccccgcgccagcggggataaaccgccagtgataagtggaatgccatgtgggctgtcgagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 353 - DNA, 4118 bp, Artificial Sequence
  Synthetic: CRISPR
taatacgactcactataggggaattgtgagcggataacaattcccctgtagaaataattttgtttaactttaataaggagatataccatggattagctgatctttaataataaggaaatgttacattaaggttggtgggttgtttttatgggaaaaaatgctttaagaacaaatgtatacttttagagagttccccgcgccagcggggataaaccgcaaacacagcatggacgacagccaggtacctagagttccccgcgccagcggggataaaccgcaaacacagcatggacgacagccaggtacctagagttccccgcgccagcggggataaaccgcaaacacagcatggacgacagccaggtacctagagttccccgcgccagcggggataaaccgaaaacaaaaggctcagtcggaagactgggccttttgttttaaccccttggggcctctaaacgggtcttgaggggttttttgctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 354 - DNA, 3797 bp, Artificial Sequence
  Synthetic: CRISPR(J3/L3)
taatacgactcactataggggaattgtgagcggataacaattcccctgtagaaataattttgtttaactttaataaggagatataccatgggctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 355 - DNA, 3797 bp, Artificial Sequence
  Synthetic: CRISPR(Hsa07)
taatacgactcactataggggaattgtgagcggataacaattcccctgtagaaataattttgtttaactttaataaggagatataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 356 - DNA, 7967 bp, Artificial Sequence
  Synthetic: His6-MBP-TEV-Cas8
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaactagtaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatgttttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaactaaggaggtccgctatgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgataataacattggaagtggataacggatccgaattcgagcgccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 357 - DNA, 6435 bp, Artificial Sequence
  Synthetic: StrepII-HRV3C-Cse2_Cas7_Cas5_Cas6
taatacgactcactataggggaattgtgagcggataacaattcccctgtagaaataattttgtttaactttaataaggagatataccatggcaagctggagccacccgcagttcgaaaagggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 358 - DNA, 7933 bp, Artificial Sequence
  Synthetic: Cas8_His6HRV3CCse2_Cas7_Cas5_Cas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 359 - DNA, 8644 bp, Artificial Sequence
  Synthetic: FokI30aaCas8_His6HRV3CCse2_Cas7_Cas5_Cas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 360 - DNA, 8710 bp, Artificial Sequence
  Synthetic: FokI30aaCas8_His6HRV3CCse2_Cas7_Cas5_NLSCas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaattaataaaggaggtatataatgccaaagaaaaaacgtaaggttggcggtagcatgtacctcagcaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 361 - DNA, 8687 bp, Artificial Sequence
  Synthetic: FokI30aaCas8_His6HRV3CCse2_Cas7NLS_Cas5_Cas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgggcggtagcccaaagaaaaaacgtaaggtttgataaaggaggtatataatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 362 - DNA, 8614 bp, Artificial Sequence
  Synthetic: Cas8_His6HRV3CCse2_Cas7_Cas5_Cas620aaFokI
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtcgggctcagaaacgccggggacatcggaatccgccacacctgagtcgggtggttctggtcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaactttggtggctctccgaaaaaaaagcgcaaagtgtaataactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 363 - DNA, 12975 bp, Artificial Sequence
  Synthetic: Polypromoter, Cas5_Cas3_Cse2_Cas7_Cas6_Cas8_CRISPR(J3)
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 364 - DNA, 12975 bp, Artificial Sequence
  Synthetic: Polypromoter, Cas5_Cas3_Cse2_Cas7_CRISPR(J3)_Cas6_Cas8
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 365 - DNA, 9499 bp, Artificial Sequence
  Synthetic: Polypromoter(EcoCO), CRISPR(J3/L3)_Cse2_Cas7_Cas5_Cas8_Cas6
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaataagcagaatgttatcaatgccatgcaggaattctagcataaccccttggggcctctaaacgggtcttgaggggttttttggttttagccagctggttgaagaactgctgaaaattatttgtgcatttcagctggataccggtctggaatatgcaaatagctacaattttgccaaaaaagataatacgactcactataggcccctgtagaaataattttgtttaactttaataaggagatataccatgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataataaggaatgtccgatttgtctggaactgggcgcctagcataaccccttggggcctctaaacgggtcttgaggggttttttgataatagcccggaacatctgaaagatgaagtgtctattattcagtcaatgggttatcgcaatcgtgcaaaacgcctgctgcagagcgaaccggaaaatcctaatacgactcactataggcccctcaagaaataattttgtttaactttaagctttaagaaggagatatagatatgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaataagaaccggttagcaccaagtgtgatcggtacccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatctgctgattgataattggattccggttcgtccgcgtaatggtggtaaagttcagattattaatctgcagagcctgtattgtagccgtgatcagtggcgtctgagcctgccgcgtgatgatatggaactggcagcactggcactgctggtttgtattggtcagattattgcaccggcaaaagatgatgttgaatttcgccatcgtattatgaatccgctgaccgaagatgaatttcagcagctgattgccccgtggattgatatgttttatctgaatcatgcagaacatccgtttatgcagaccaaaggtgttaaagcaaatgatgttaccccgatggaaaaactgctggccggtgttagcggtgcaaccaattgtgcatttgttaatcagccgggtcagggtgaagcactgtgtggtggttgtaccgcaattgcactgtttaatcaggcgaatcaggccccgggttttggtggtggttttaaaagcggtctgcgtggtggtacaccggttaccacctttgttcgtggtattgatctgcgtagcaccgttctgctgaatgttctgaccctgccgcgtctgcagaaacagtttccgaatgaaagccataccgaaaatcagccgacctggattaaaccgattaaaagcaatgaaagcattccggcaagcagcattggttttgtgcgtggtctgttttggcagccggcacatattgaactgtgtgatccgattggtattggtaaatgtagctgttgtggtcaggaaagcaatctgcgttataccggctttctgaaagagaaatttacctttaccgttaatggtctgtggccgcatccgcatagcccgtgtctggttaccgtgaaaaaaggtgaagttgaagaaaaatttctggcatttaccaccagcgcaccgagctggacccagattagccgtgttgttgttgataaaattattcagaatgaaaatggcaatcgtgttgcagcagttgtgaatcagtttcgtaatattgcgccgcagagcccgctggaactaattatgggtggttatcgtaataatcaggcaagcattctggaacgccgtcatgatgttctgatgtttaatcagggttggcagcagtatggtaatgtgattaatgaaattgtgaccgttggtctgggctataaaaccgcactgcgtaaagcgctgtatacctttgccgaaggctttaaaaacaaagattttaaaggtgcaggcgttagcgttcatgaaaccgccgaacgtcatttttatcgtcagagcgaactgctgattccggatgtgctggcaaatgttaattttagccaggcagatgaagttattgcagatctgcgcgataaactgcatcagctgtgtgaaatgctgtttaatcagagcgttgcaccgtatgcacatcatccgaaactgattagcaccctggccctggcacgtgcaaccctgtataaacatctgcgtgaactgaaaccgcagggtggtccgagcaatggttaataaggatctgtcagcactgcgtgttgaaggatcccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaataagtccgagtcagtgtcctctgtgtaaccatgggatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 366 - DNA, 10210 bp, Artificial Sequence
  Synthetic: Polypromoter(EcoCO), CRISPR(J3/L3)_Cse2_Cas7_Cas5_Cas8_FokI-30aa-Cas6
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaataagcagaatgttatcaatgccatgcaggaattctagcataaccccttggggcctctaaacgggtcttgaggggttttttggttttagccagctggttgaagaactgctgaaaattatttgtgcatttcagctggataccggtctggaatatgcaaatagctacaattttgccaaaaaagataatacgactcactataggcccctgtagaaataattttgtttaactttaataaggagatataccatgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataataaggaatgtccgatttgtctggaactgggcgcctagcataaccccttggggcctctaaacgggtcttgaggggttttttgataatagcccggaacatctgaaagatgaagtgtctattattcagtcaatgggttatcgcaatcgtgcaaaacgcctgctgcagagcgaaccggaaaatcctaatacgactcactataggcccctcaagaaataattttgtttaactttaagctttaagaaggagatatagatatgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaataagaaccggttagcaccaagtgtgatcggtacccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatctgctgattgataattggattccggttcgtccgcgtaatggtggtaaagttcagattattaatctgcagagcctgtattgtagccgtgatcagtggcgtctgagcctgccgcgtgatgatatggaactggcagcactggcactgctggtttgtattggtcagattattgcaccggcaaaagatgatgttgaatttcgccatcgtattatgaatccgctgaccgaagatgaatttcagcagctgattgccccgtggattgatatgttttatctgaatcatgcagaacatccgtttatgcagaccaaaggtgttaaagcaaatgatgttaccccgatggaaaaactgctggccggtgttagcggtgcaaccaattgtgcatttgttaatcagccgggtcagggtgaagcactgtgtggtggttgtaccgcaattgcactgtttaatcaggcgaatcaggccccgggttttggtggtggttttaaaagcggtctgcgtggtggtacaccggttaccacctttgttcgtggtattgatctgcgtagcaccgttctgctgaatgttctgaccctgccgcgtctgcagaaacagtttccgaatgaaagccataccgaaaatcagccgacctggattaaaccgattaaaagcaatgaaagcattccggcaagcagcattggttttgtgcgtggtctgttttggcagccggcacatattgaactgtgtgatccgattggtattggtaaatgtagctgttgtggtcaggaaagcaatctgcgttataccggctttctgaaagagaaatttacctttaccgttaatggtctgtggccgcatccgcatagcccgtgtctggttaccgtgaaaaaaggtgaagttgaagaaaaatttctggcatttaccaccagcgcaccgagctggacccagattagccgtgttgttgttgataaaattattcagaatgaaaatggcaatcgtgttgcagcagttgtgaatcagtttcgtaatattgcgccgcagagcccgctggaactaattatgggtggttatcgtaataatcaggcaagcattctggaacgccgtcatgatgttctgatgtttaatcagggttggcagcagtatggtaatgtgattaatgaaattgtgaccgttggtctgggctataaaaccgcactgcgtaaagcgctgtatacctttgccgaaggctttaaaaacaaagattttaaaggtgcaggcgttagcgttcatgaaaccgccgaacgtcatttttatcgtcagagcgaactgctgattccggatgtgctggcaaatgttaattttagccaggcagatgaagttattgcagatctgcgcgataaactgcatcagctgtgtgaaatgctgtttaatcagagcgttgcaccgtatgcacatcatccgaaactgattagcaccctggccctggcacgtgcaaccctgtataaacatctgcgtgaactgaaaccgcagggtggtccgagcaatggttaataaggatctgtcagcactgcgtgttgaaggatcccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaataagtccgagtcagtgtcctctgtgtaaccatgggatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 367 - DNA, 10201 bp, Artificial Sequence
  Synthetic: Polypromoter(EcoCO), CRISPR(J3/L3)_Cse2_Cas7_Cas5_Cas6_FokI-30aa-Cas8
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaataagcagaatgttatcaatgccatgcaggaattctagcataaccccttggggcctctaaacgggtcttgaggggttttttggttttagccagctggttgaagaactgctgaaaattatttgtgcatttcagctggataccggtctggaatatgcaaatagctacaattttgccaaaaaagataatacgactcactataggcccctgtagaaataattttgtttaactttaataaggagatataccatgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataataaggaatgtccgatttgtctggaactgggcgcctagcataaccccttggggcctctaaacgggtcttgaggggttttttgataatagcccggaacatctgaaagatgaagtgtctattattcagtcaatgggttatcgcaatcgtgcaaaacgcctgctgcagagcgaaccggaaaatcctaatacgactcactataggcccctcaagaaataattttgtttaactttaagctttaagaaggagatatagatatgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaataagaaccggttagcaccaagtgtgatcggtacccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaataagtccgagtcagtgtcctctgtgtaaccatgggatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgccgaaaaaaaagcgcaaagtgcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctaataaggatctgtcagcactgcgtgttgaaggatccgatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 368 - DNA, 6926 bp, Artificial Sequence
  Synthetic: Cas8, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 369 - DNA, 6925 bp, Artificial Sequence
  Synthetic: NLSCas8, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 370 - DNA, 7630 bp, Artificial Sequence
  Synthetic: NLSHAFokI30aaCas8, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggctcaggctatccctatgacgtacccgactacgcgcaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 371 - DNA, 5933 bp, Artificial Sequence
  Synthetic: NLSCse2, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgccgaaaaaaaagcggaaggtcggatcaggaatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 372 - DNA, 6542 bp, Artificial Sequence
  Synthetic: NLS-Cas7, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgccgaaaaaaaagcggaaggtcggatcaggaatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 373 - DNA, 6092 bp, Artificial Sequence
  Synthetic: Cas5, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 374 - DNA, 6091 bp, Artificial Sequence
  Synthetic: NLSCas5, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 375 - DNA, 6017 bp, Artificial Sequence
  Synthetic: Cas6, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 376 - DNA, 6016 bp, Artificial Sequence
  Synthetic: NLSCas6, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 377 - DNA, 6736 bp, Artificial Sequence
  Synthetic: NLSV5FokI30aaCas8, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggctcaggcggtaaacccatcccaaaccccttgcttggtctcgactcaacccaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 378 - DNA, 8114 bp, Artificial Sequence
  Synthetic: Cas3NLS, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatggagccttttaaatatatttgtcattactggggtaagagttccaagagcctgacaaaaggcaatgatatacatcttttgatctatcactgtctcgacgtcgcagcggtagcggattgctggtgggatcaaagtgtcgtgctccagaacacgttttgtcgaaacgaaatgctcagcaagcagcgggtaaaagcatggctccttttctttattgctctccacgacataggcaaattcgacattaggttccagtacaaatctgcagagagttggttgaaattgaacccggccacccctagcctgaacggcccttcaactcagatgtgcaggaaatttaaccatggagccgctgggttgtattggtttaatcaggacagtttgtcagagcaaagtctgggggatttcttctccttttttgacgccgcgcctcatccttacgagagctggtttccatgggtcgaggccgtcacagggcaccatggctttattcttcactctcaggaccaagacaaatctcgatgggaaatgcctgccagtctggcgtcttacgccgcgcaggataagcaagcacgagaagaatggatttccgtcttggaggcgctgtttctcacacccgccgggctctctatcaacgacataccccccgattgctctagtctgcttgccggtttttgctcccttgccgattggcttggttcatggacgaccaccaatacgtttttgttcaatgaagatgcaccatctgatataaatgcattgaggacgtattttcaagacagacagcaagatgcctccagagttttggagctttctggacttgtatcaaataagagatgctacgaaggagtgcatgctctgctggacaacggctaccagccacgacaacttcaagttctcgttgatgccctcccggtggctccggggttgaccgtcatagaggcgcctactggatcagggaagaccgagacagccttggcctatgcgtggaaactgatagatcaacagattgccgactcagtgatcttcgcgctgccaactcaggcaacagccaacgcgatgctgacacgcatggaggccagcgcaagtcaccttttctctagtccaaatctgatactggcccatggtaattctaggtttaaccatctgtttcagtccatcaagtctagggcgataactgagcaaggacaggaagaagcctgggttcaatgctgccagtggcttagccagagtaacaagaaagtattcttgggacagattggtgtctgcacaatagaccaagtactcatctcagttttgcctgttaagcaccgattcatacgaggacttggaatcgggcgcagtgtcctcatagtagatgaggtgcatgcttacgacacctacatgaacggtttgctcgaggcggtgctcaaagcacaagctgatgtcggaggtagcgtgatccttctcagcgctacgcttcctatgaaacagaagcagaagttgctcgatacctatggtctgcatacggatcctgtggaaaataatagtgcctaccccctcataaactggaggggagtaaatggtgcacagaggtttgaccttcttgctcaccctgagcagcttcctccccggttttccatacagccggagccgatttgtcttgccgacatgcttccagatctcacaatgctcgaacggatgatcgcggccgctaatgccggcgcacaagtctgtctcatctgtaaccttgtcgatgtagcgcaggtttgttaccaacgactcaaagaactgaataatacacaagtagacatagatctgttccatgctcgctttacactcaatgacagaagggaaaaagaaaatcgggtcatctcaaattttggtaagaacggaaaacgaaacgttggccgaatcctcgtcgcaacccaggtagtggagcagtccctcgatgtggactttgactggcttattacacagcactgccctgctgacctcctgttccagcgacttggcagattgcatagacatcaccggaaatatcggcctgcaggttttgagataccagtcgcaactattcttctccccgacggggaagggtacgggcgacacgagcacatctatagcaacgtacgggtaatgtggcggacgcaacaacacatcgaggaacttaacggagcatccctgtttttccccgatgcctatagacaatggctcgacagtatttatgatgacgccgaaatggacgaacccgagtgggtcggaaatggtatggataaatttgaatccgcagaatgtgaaaaacggttcaaagcacggaaggtcctccagtgggctgaggagtattcattgcaggataacgacgaaaccatcttggctgtcactagagacggcgaaatgtcccttccactgcttccttatgttcaaacctcttctgggaaacagcttcttgatggccaggtatatgaggacctgtcccacgaacaacagtacgaggcacttgccttgaaccgcgttaatgtacctttcacttggaaacgatcattttcagaggtcgtagatgaagatgggctcctttggctggaaggcaaacaaaacctggatggatgggtatggcagggaaactctattgtaataacatacactggcgatgagggtatgacgagggttataccggcgaatccgaaatccgggtcacccaaaaagaagagaaaagtataataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 379 - DNA, 4804 bp, Artificial Sequence
  Synthetic: CRISPR(Hsa07)
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggcctcaccgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccgtttttttcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 380 - DNA, 8701 bp, Artificial Sequence
  Synthetic: Polycistronic(HsCO), NLSCas7_NLSCse2_NLSCas5_NLSCas6
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 381 - DNA, 10300 bp, Artificial Sequence
  Synthetic: Polycistronic(HsCO), NLSCas7_NLSCse2_NLSCas5_NLSCas6_NLSCas8
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 382 - DNA, 10978 bp, Artificial Sequence
  Synthetic: Polycistronic(HsCO), NLSCas7_NLSCse2_NLSCas5_NLSCas6_NLSFokI30aaCas8
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 383 - DNA, 10813 bp, Artificial Sequence
  Synthetic: Polycistronic(HsCO), NLSCas7_NLSCse2_NLSCas5_NLSCas6_NLSFokI30aaCas8, no epitope tags
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 384 - DNA, 10813 bp, Artificial Sequence
  Synthetic: Polycistronic(HsCO), NLSCas7_NLSCse2_NLSCas5_NLSFokI30aaCas6_NLSCas8, no epitope tags
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggccaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 385 - DNA, 6475 bp, Artificial Sequence
  Synthetic: eGFP_MALAT1-triplex_CRISPR(Hsa07)
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgggctccgggattggtagtgggagcaacggcagcagcggatccgtgagcaagggcgaggagctgttcaccggggtggtgcccatcctggtcgagctggacggcgacgtaaacggccacaagttcagcgtgcgcggcgagggcgagggcgatgccaccaacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatctccttcaaggacgacggcacctacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcacggccgacaagcagaagaacggcatcaaggcgaacttcaagatccgccacaacgtcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaagtagtaatctagagattcgtcagtagggttgtaaaggtttttcttttcctgagaaaacaaccttttgttttctcaggttttgctttttggcctttccctagctttaaaaaaaaaaaagcaaaactcaccgaggcagttataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 386 - DNA, 6854 bp, Artificial Sequence
  Synthetic: NLSCas7_MALAT1-triplex_CRISPR(Hsa07)
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgccgaaaaaaaagcggaaggtcggatcaggaatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaataacattggaagtggataatctagagattcgtcagtagggttgtaaaggtttttcttttcctgagaaaacaaccttttgttttctcaggttttgctttttggcctttccctagctttaaaaaaaaaaaagcaaaactcaccgaggcagttataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 387 - DNA, 6328 bp, Artificial Sequence
  Synthetic: NLSCas6_MALAT1-triplex_CRISPR(Hsa07)
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagattcgtcagtagggttgtaaaggtttttcttttcctgagaaaacaaccttttgttttctcaggttttgctttttggcctttccctagctttaaaaaaaaaaaagcaaaactcaccgaggcagttataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 388 - DNA, 11541 bp, Artificial Sequence
  Synthetic: hU6_CRISPR(Hsa07)_F, CMV_NLSCas7_NLSCse2_NLSCas5_NLSCas6_NLSFokI30aaCas8
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggatcctaatacgactcactatagggtaaggagatataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaataactctgaaacctcaggcatttgagaagtctagatttttttcggaaagaaccagctggggctctagggggtatccccacgcgccctgtagcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 389 - DNA, 11541 bp, Artificial Sequence
  Synthetic: hU6_CRISPR(Hsa07)_R, CMV_NLSCas7_NLSCse2_NLSCas5_NLSCas6_NLSFokI30aaCas8
ctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtgctacagggcgcgtggggataccccctagagccccagctggttctttccgaaaaaaatctagacttctcaaatgcctgaggtttcagagttattgctcagcgagctccggtttatccccgctggcgcggggaactcctgaaggcctaggcaaagaagaacacaacttacggtttatccccgctggcgcggggaactcagactgtgtaacaccaatgcaggcaaatcaaccggtttatccccgctggcgcggggaactcgctagcccatggtatatctccttaccctatagtgagtcgtattaggatccggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattccaattatctctctaacagccttgtatcgtatatgcaaatatgaaggaatcatgggaaataggccctcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggt

SEQ ID NO: 390 - DNA, 555 bp, Artificial Sequence
  Synthetic: StrepIIHRV3C-Cse2
atggcaagctggagccacccgcagttcgaaaagggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaa

SEQ ID NO: 391 - protein, 184 aa, Artificial Sequence
  Synthetic: StrepIIHRV3C-Cse2
MASWSHPQFEKGALEVLFQGPGYQMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 392 - DNA, 549 bp, Artificial Sequence
  Synthetic: His6HRV3CCse2
atggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaa

SEQ ID NO: 393 - protein, 182 aa, Artificial Sequence
  Synthetic: His6HRV3CCse2
MAEHHHHHHGALEVLFQGPGYQMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 394 - DNA, 516 bp, Artificial Sequence
  Synthetic: NLSCse2
atgccgaaaaaaaagcggaaggtcggatcaggaatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaa

SEQ ID NO: 395 - protein, 171 aa, Artificial Sequence
  Synthetic: NLSCse2
MPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 396 - DNA, 708 bp, Artificial Sequence
  Synthetic: NLSCas5
atgcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaa

SEQ ID NO: 397 - protein, 235 aa, Artificial Sequence
  Synthetic: NLSCas5
MPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 398 - DNA, 633 bp, Artificial Sequence
  Synthetic: NLS-Cas6
atgccaaagaaaaaacgtaaggttggcggtagcatgtacctcagcaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtga

SEQ ID NO: 399 - protein, 210 aa, Artificial Sequence
  Synthetic: NLS-Cas6
MPKKKRKVGGSMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 400 - DNA, 669 bp, Artificial Sequence
  Synthetic: NLS-HA-Cas6
atgccaaagaaaaaacgtaaggttggcggtagctatccgtacgatgttccagactacgccggcggctccatgtacctcagcaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtga

SEQ ID NO: 401 - protein, 222 aa, Artificial Sequence
  Synthetic: NLS-HA-Cas6
MPKKKRKVGGSYPYDVPDYAGGSMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 402 - DNA, 633 bp, Artificial Sequence
  Synthetic: NLS-Cas6
atgcccaagaaaaagagaaaagtaggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaa

SEQ ID NO: 403 - protein, 210 aa, Artificial Sequence
  Synthetic: NLS-Cas6
MPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 404 - DNA, 1122 bp, Artificial Sequence
  Synthetic: Cas7-NLS
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgggcggtagcccaaagaaaaaacgtaaggtttga

SEQ ID NO: 405 - protein, 373 aa, Artificial Sequence
  Synthetic: Cas7-NLS
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGGSPKKKRKV

SEQ ID NO: 406 - DNA, 1158 bp, Artificial Sequence
  Synthetic: Cas7-HA-NLS
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgggcggctcctatccgtacgatgttccagactacgccggcggtagcccaaagaaaaaacgtaaggtttga

SEQ ID NO: 407 - protein, 385 aa, Artificial Sequence
  Synthetic: Cas7-HA-NLS
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGGSYPYDVPDYAGGSPKKKRKV

SEQ ID NO: 408 - DNA, 1125 bp, Artificial Sequence
  Synthetic: NLS-Cas7
atgccgaaaaaaaagcggaaggtcggatcaggaatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaa

SEQ ID NO: 409 - protein, 374 aa, Artificial Sequence
  Synthetic: NLS-Cas7
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 410 - DNA, 2670 bp, Artificial Sequence
  Synthetic: His6-MBP-TEV-Cas8
atgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctga

SEQ ID NO: 411 - protein, 889 aa, Artificial Sequence
  Synthetic: His6-MBP-TEV-Cas8
MHHHHHHGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNGIEENLYFQSNAMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 412 - DNA, 3369 bp, Artificial Sequence
  Synthetic: His6-MBP-TEV-NLS-FokI-linker-Cas8
atgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatatgccgaaaaaaaagcgcaaagtgcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctga

SEQ ID NO: 413 - protein, 1122 aa, Artificial Sequence
  Synthetic: His6-MBP-TEV-NLS-FokI-linker-Cas8
MHHHHHHGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNGIEENLYFQSNMPKKKRKVQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFSGSETPGTSESATPESGGSGSSGGSGSSGGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 414 - DNA, 1542 bp, Artificial Sequence
  Synthetic: NLS-Cas8
atgcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaa

SEQ ID NO: 415 - protein, 513 aa, Artificial Sequence
  Synthetic: NLS-Cas8
MPKKKRKVGSGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 416 - DNA, 2247 bp, Artificial Sequence
  Synthetic: NLS-HA-FokI-linker-Cas8
atgcccaagaaaaagagaaaagtaggctcaggctatccctatgacgtacccgactacgcgcaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaa

SEQ ID NO: 417 - protein, 748 aa, Artificial Sequence
  Synthetic: NLS-HA-FokI-linker-Cas8
MPKKKRKVGSGYPYDVPDYAQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFSGSETPGTSESATPESGGSGSSGGSGSSGGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 418 - protein, 6 aa, Artificial Sequence
  Synthetic: hexahistidine
HHHHHH

SEQ ID NO: 419 - protein, 8 aa, Artificial Sequence
  Synthetic: Strep-tag
WSHPQFEK

SEQ ID NO: 420 - protein, 8 aa, Artificial Sequence
  Synthetic: HRV3C (human rhinovirus 3C) protease recognition sequence
LEVLFQGP

SEQ ID NO: 421 - protein, 7 aa, Artificial Sequence
  Synthetic: nuclear localization signal
PKKKRKV

SEQ ID NO: 422 - protein, 9 aa, Artificial Sequence
  Synthetic: hemagglutinin
YPYDVPDYA

SEQ ID NO: 423 - protein, 367 aa, Artificial Sequence
  Synthetic: maltose binding protein
KIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTN

SEQ ID NO: 424 - protein, 7 aa, Artificial Sequence
  Synthetic: TEV (tobacco etch virus) protease recognition sequence
ENLYFQS

SEQ ID NO: 425 - protein, 30 aa, Artificial Sequence
  Synthetic: linker polypeptide
SGSETPGTSESATPESGGSGSSGGSGSSGG

SEQ ID NO: 426 - protein, 5 aa, Artificial Sequence
  Synthetic: 5-amino acid linker, FokI-Cas8 fusion
GGGGS

SEQ ID NO: 427 - protein, 8 aa, Artificial Sequence
  Synthetic: 8-amino acid linker, FokI-Cas8 fusion
TGPGAAAR

SEQ ID NO: 428 - protein, 10 aa, Artificial Sequence
  Synthetic: 10-amino acid linker, FokI-Cas8 fusion
GGSGSSGGSG

SEQ ID NO: 429 - protein, 12 aa, Artificial Sequence
  Synthetic: 12-amino acid linker, FokI-Cas8 fusion
TGPGAAARAASG

SEQ ID NO: 430 - protein, 15 aa, Artificial Sequence
  Synthetic: 15-amino acid linker, FokI-Cas8 fusion
GGSGSSGGSGSSGGS

SEQ ID NO: 431 - protein, 16 aa, Artificial Sequence
  Synthetic: 16-amino acid linker, FokI-Cas8 fusion
SGSETPGTSESATPES

SEQ ID NO: 432 - protein, 20 aa, Artificial Sequence
  Synthetic: 20-amino acid linker, FokI-Cas8 fusion
SGSETPGTSESATPESGGSG

SEQ ID NO: 433 - protein, 30 aa, Artificial Sequence; identical to SEQ ID NO: 425
  Synthetic: 30-amino acid linker, FokI-Cas8 fusion

SEQ ID NO: 434 - DNA, 90 bp, Artificial Sequence
  Synthetic: CRISPR(J3)
gagttccccgcgccagcggggataaaccgccagtgataagtggaatgccatgtgggctgtcgagttccccgcgccagcggggataaaccg

SEQ ID NO: 435 - DNA, 90 bp, Artificial Sequence
  Synthetic: CRISPR(L3)
gagttccccgcgccagcggggataaaccgagtggcagatatagcctggtggttcaggcggcgagttccccgcgccagcggggataaaccg

SEQ ID NO: 436 - DNA, 151 bp, Artificial Sequence
  Synthetic: CRISPR(J3/L3)
gagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccg

SEQ ID NO: 437 - DNA, 151 bp, Artificial Sequence
  Synthetic: CRISPR(TRAC)
gagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccg

SEQ ID NO: 438 - DNA, 7967 bp, Artificial Sequence; identical to SEQ ID NO: 356
  Synthetic: His6-MBP-TEV-Cas8

SEQ ID NO: 439 - DNA, 8659 bp, Artificial Sequence
  Synthetic: His6-MBP-TEV-NLS-Fok1-linker-Cas8
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaactagtaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatgttttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaactaaggaggtccgctatgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatatgccgaaaaaaaagcgcaaagtgcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgaattggaagtggataacggatccgaattcgagcgccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 440 - DNA, 6435 bp, Artificial Sequence; identical to SEQ ID NO: 357
  Synthetic: StrepII-HRV3C-Cse2_Cas7_Cas5_Cas6

SEQ ID NO: 441 - DNA, 7933 bp, Artificial Sequence; identical to SEQ ID NO: 358
  Synthetic: Cas8_His6HRV3CCse2_Cas7_Cas5_Cas6

SEQ ID NO: 442 - DNA, 8644 bp, Artificial Sequence; identical to SEQ ID NO: 359
  Synthetic: NLS-FokI-linker-Cas8_His6HRV3CCse2_Cas7_Cas5_Cas6

SEQ ID NO: 443 - DNA, 8687 bp, Artificial Sequence; identical to SEQ ID NO: 361
  Synthetic: NLS-FokI-linker-Cas8_His6HRV3CCse2_Cas7-NLS_Cas5_Cas6

SEQ ID NO: 444 - DNA, 3736 bp, Artificial Sequence; identical to SEQ ID NO: 352
  Synthetic: CRISPR(J3)

SEQ ID NO: 445 - DNA, 3736 bp, Artificial Sequence
  Synthetic: CRISPR(L3)
taatacgactcactataggggaattgtgagcggataacaattcccctgtagaaataattttgtttaactttaataaggagatataccatgggctagcgagttccccgcgccagcggggataaaccgagtggcagatatagcctggtggttcaggcggcgagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 446 - DNA, 3797 bp, Artificial Sequence; identical to SEQ ID NO: 354
  Synthetic: CRISPR(J3/L3)

SEQ ID NO: 447 - DNA, 3797 bp, Artificial Sequence; identical to SEQ ID NO: 355
  Synthetic: CRISPR(TRAC)

SEQ ID NO: 448 - DNA, 5974 bp, Artificial Sequence
  Synthetic: Cse2
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 449 - DNA, 6091 bp, Artificial Sequence; identical to SEQ ID NO: 374
  Synthetic: Cas5

SEQ ID NO: 450 - DNA, 6052 bp, Artificial Sequence
  Synthetic: Cas6
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggctcaggctatccctatgacgtacccgactacgcgggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 451 - DNA, 6547 bp, Artificial Sequence
  Synthetic: Cas7
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 452 - DNA, 6925 bp, Artificial Sequence; identical to SEQ ID NO: 369
  Synthetic: Cas8

SEQ ID NO: 453 - DNA, 7630 bp, Artificial Sequence; identical to SEQ ID NO: 370
  Synthetic: FokI-Cas8

SEQ ID NO: 454 - DNA, 4804 bp, Artificial Sequence; identical to SEQ ID NO: 379
  Synthetic: CRISPR(TRAC)

SEQ ID NO: 455 - DNA, 10813 bp, Artificial Sequence; identical to SEQ ID NO: 383
  Synthetic: NLS-Cas7_NLS-Cse2_NLS-Cas5_NLS-Cas6_NLS-FokI-Cas8

SEQ ID NO: 456 - DNA, 11541 bp, Artificial Sequence; identical to SEQ ID NO: 388
  Synthetic: hU6_CRISPR(TRAC), CMV_NLSCas7_NLSCse2_NLSCas5_NLSCas6_NLSFokICas8

SEQ ID NO: 457 - DNA, 2667 bp, Artificial Sequence
  Synthetic: Cas3
atggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataa

SEQ ID NO: 458 - protein, 888 aa, Artificial Sequence; identical to SEQ ID NO: 21
  Synthetic: Cas3

SEQ ID NO: 459 - DNA, 3828 bp, Artificial Sequence
  Synthetic: His6-MBP-TEV-Cas3
atgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataa

SEQ ID NO: 460 - protein, 1275 aa, Artificial Sequence
  Synthetic: His6-MBP-TEV-Cas3
MHHHHHHGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNGIEENLYFQSNAMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 461 - DNA, 9125 bp, Artificial Sequence
  Synthetic: His6-MBP-TEV-Cas3
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaactagtaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatgttttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaactaaggaggtccgctatgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataataataacattggaagtggataacggatccgaattcgagcgccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 462 - DNA, 2667 bp, Artificial Sequence
  Synthetic: Cas3, human codon optimized
atggagccttttaaatatatttgtcattactggggtaagagttccaagagcctgacaaaaggcaatgatatacatcttttgatctatcactgtctcgacgtcgcagcggtagcggattgctggtgggatcaaagtgtcgtgctccagaacacgttttgtcgaaacgaaatgctcagcaagcagcgggtaaaagcatggctccttttctttattgctctccacgacataggcaaattcgacattaggttccagtacaaatctgcagagagttggttgaaattgaacccggccacccctagcctgaacggcccttcaactcagatgtgcaggaaatttaaccatggagccgctgggttgtattggtttaatcaggacagtttgtcagagcaaagtctgggggatttcttctccttttttgacgccgcgcctcatccttacgagagctggtttccatgggtcgaggccgtcacagggcaccatggctttattcttcactctcaggaccaagacaaatctcgatgggaaatgcctgccagtctggcgtcttacgccgcgcaggataagcaagcacgagaagaatggatttccgtcttggaggcgctgtttctcacacccgccgggctctctatcaacgacataccccccgattgctctagtctgcttgccggtttttgctcccttgccgattggcttggttcatggacgaccaccaatacgtttttgttcaatgaagatgcaccatctgatataaatgcattgaggacgtattttcaagacagacagcaagatgcctccagagttttggagctttctggacttgtatcaaataagagatgctacgaaggagtgcatgctctgctggacaacggctaccagccacgacaacttcaagttctcgttgatgccctcccggtggctccggggttgaccgtcatagaggcgcctactggatcagggaagaccgagacagccttggcctatgcgtggaaactgatagatcaacagattgccgactcagtgatcttcgcgctgccaactcaggcaacagccaacgcgatgctgacacgcatggaggccagcgcaagtcaccttttctctagtccaaatctgatactggcccatggtaattctaggtttaaccatctgtttcagtccatcaagtctagggcgataactgagcaaggacaggaagaagcctgggttcaatgctgccagtggcttagccagagtaacaagaaagtattcttgggacagattggtgtctgcacaatagaccaagtactcatctcagttttgcctgttaagcaccgattcatacgaggacttggaatcgggcgcagtgtcctcatagtagatgaggtgcatgcttacgacacctacatgaacggtttgctcgaggcggtgctcaaagcacaagctgatgtcggaggtagcgtgatccttctcagcgctacgcttcctatgaaacagaagcagaagttgctcgatacctatggtctgcatacggatcctgtggaaaataatagtgcctaccccctcataaactggaggggagtaaatggtgcacagaggtttgaccttcttgctcaccctgagcagcttcctccccggttttccatacagccggagccgatttgtcttgccgacatgcttccagatctcacaatgctcgaacggatgatcgcggccgctaatgccggcgcacaagtctgtctcatctgtaaccttgtcgatgtagcgcaggtttgttaccaacgactcaaagaactgaataatacacaagtagacatagatctgttccatgctcgctttacactcaatgacagaagggaaaaagaaaatcgggtcatctcaaattttggtaagaacggaaaacgaaacgttggccgaatcctcgtcgcaacccaggtagtggagcagtccctcgatgtggactttgactggcttattacacagcactgccctgctgacctcctgttccagcgacttggcagattgcatagacatcaccggaaatatcggcctgcaggttttgagataccagtcgcaactattcttctccccgacggggaagggtacgggcgacacgagcacatctatagcaacgtacgggtaatgtggcggacgcaacaacacatcgaggaacttaacggagcatccctgtttttccccgatgcctatagacaatggctcgacagtatttatgatgacgccgaaatggacgaacccgagtgggtcggaaatggtatggataaatttgaatccgcagaatgtgaaaaacggttcaaagcacggaaggtcctccagtgggctgaggagtattcattgcaggataacgacgaaaccatcttggctgtcactagagacggcgaaatgtcccttccactgcttccttatgttcaaacctcttctgggaaacagcttcttgatggccaggtatatgaggacctgtcccacgaacaacagtacgaggcacttgccttgaaccgcgttaatgtacctttcacttggaaacgatcattttcagaggtcgtagatgaagatgggctcctttggctggaaggcaaacaaaacctggatggatgggtatggcagggaaactctattgtaataacatacactggcgatgagggtatgacgagggttataccggcgaatccgaaataa

SEQ ID NO: 463 - DNA, 2697 bp, Artificial Sequence
  Synthetic: Cas3-NLS
atggagccttttaaatatatttgtcattactggggtaagagttccaagagcctgacaaaaggcaatgatatacatcttttgatctatcactgtctcgacgtcgcagcggtagcggattgctggtgggatcaaagtgtcgtgctccagaacacgttttgtcgaaacgaaatgctcagcaagcagcgggtaaaagcatggctccttttctttattgctctccacgacataggcaaattcgacattaggttccagtacaaatctgcagagagttggttgaaattgaacccggccacccctagcctgaacggcccttcaactcagatgtgcaggaaatttaaccatggagccgctgggttgtattggtttaatcaggacagtttgtcagagcaaagtctgggggatttcttctccttttttgacgccgcgcctcatccttacgagagctggtttccatgggtcgaggccgtcacagggcaccatggctttattcttcactctcaggaccaagacaaatctcgatgggaaatgcctgccagtctggcgtcttacgccgcgcaggataagcaagcacgagaagaatggatttccgtcttggaggcgctgtttctcacacccgccgggctctctatcaacgacataccccccgattgctctagtctgcttgccggtttttgctcccttgccgattggcttggttcatggacgaccaccaatacgtttttgttcaatgaagatgcaccatctgatataaatgcattgaggacgtattttcaagacagacagcaagatgcctccagagttttggagctttctggacttgtatcaaataagagatgctacgaaggagtgcatgctctgctggacaacggctaccagccacgacaacttcaagttctcgttgatgccctcccggtggctccggggttgaccgtcatagaggcgcctactggatcagggaagaccgagacagccttggcctatgcgtggaaactgatagatcaacagattgccgactcagtgatcttcgcgctgccaactcaggcaacagccaacgcgatgctgacacgcatggaggccagcgcaagtcaccttttctctagtccaaatctgatactggcccatggtaattctaggtttaaccatctgtttcagtccatcaagtctagggcgataactgagcaaggacaggaagaagcctgggttcaatgctgccagtggcttagccagagtaacaagaaagtattcttgggacagattggtgtctgcacaatagaccaagtactcatctcagttttgcctgttaagcaccgattcatacgaggacttggaatcgggcgcagtgtcctcatagtagatgaggtgcatgcttacgacacctacatgaacggtttgctcgaggcggtgctcaaagcacaagctgatgtcggaggtagcgtgatccttctcagcgctacgcttcctatgaaacagaagcagaagttgctcgatacctatggtctgcatacggatcctgtggaaaataatagtgcctaccccctcataaactggaggggagtaaatggtgcacagaggtttgaccttcttgctcaccctgagcagcttcctccccggttttccatacagccggagccgatttgtcttgccgacatgcttccagatctcacaatgctcgaacggatgatcgcggccgctaatgccggcgcacaagtctgtctcatctgtaaccttgtcgatgtagcgcaggtttgttaccaacgactcaaagaactgaataatacacaagtagacatagatctgttccatgctcgctttacactcaatgacagaagggaaaaagaaaatcgggtcatctcaaattttggtaagaacggaaaacgaaacgttggccgaatcctcgtcgcaacccaggtagtggagcagtccctcgatgtggactttgactggcttattacacagcactgccctgctgacctcctgttccagcgacttggcagattgcatagacatcaccggaaatatcggcctgcaggttttgagataccagtcgcaactattcttctccccgacggggaagggtacgggcgacacgagcacatctatagcaacgtacgggtaatgtggcggacgcaacaacacatcgaggaacttaacggagcatccctgtttttccccgatgcctatagacaatggctcgacagtatttatgatgacgccgaaatggacgaacccgagtgggtcggaaatggtatggataaatttgaatccgcagaatgtgaaaaacggttcaaagcacggaaggtcctccagtgggctgaggagtattcattgcaggataacgacgaaaccatcttggctgtcactagagacggcgaaatgtcccttccactgcttccttatgttcaaacctcttctgggaaacagcttcttgatggccaggtatatgaggacctgtcccacgaacaacagtacgaggcacttgccttgaaccgcgttaatgtacctttcacttggaaacgatcattttcagaggtcgtagatgaagatgggctcctttggctggaaggcaaacaaaacctggatggatgggtatggcagggaaactctattgtaataacatacactggcgatgagggtatgacgagggttataccggcgaatccgaaatccgggtcacccaaaaagaagagaaaagtataa

SEQ ID NO: 464 - protein, 898 aa, Artificial Sequence
  Synthetic: Cas3-NLS
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKSGSPKKKRKV

SEQ ID NO: 465 - DNA, 8114 bp, Artificial Sequence; identical to SEQ ID NO: 378
  Synthetic: Cas3-NLS

SEQ ID NO: 466 - DNA, 75 bp, Artificial Sequence
  Synthetic: Forward oligo, J3 target sequence
atcatcctcctgacaattttgacagcccacatggcattccacttatcactggcatctttaaaagccaggacggtc

SEQ ID NO: 467 - DNA, 75 bp, Artificial Sequence
  Synthetic: Reverse oligo, J3 target sequence
gaccgtcctggcttttaaagatgccagtgataagtggaatgccatgtgggctgtcaaaattgtcaggaggatgat

SEQ ID NO: 468 - DNA, 75 bp, Artificial Sequence
  Synthetic: target strand J3
cgccgagctcgaattcttttgacagcccacatggcattccacttatcactggcatggatcctggctgtggtgatg

SEQ ID NO: 469 - DNA, 75 bp, Artificial Sequence
  Synthetic: non target strand J3
catcaccacagccaggatccatgccagtgataagtggaatgccatgtgggctgtcaaaagaattcgagctcggcg

SEQ ID NO: 470 - DNA, 75 bp, Artificial Sequence
  Synthetic: target strand CCR5 Site
cgccgagctcgaattctttttaggtacctggctgtcgtccatgctgtgtttgcatggatcctggctgtggtgatg

SEQ ID NO: 471 - DNA, 75 bp, Artificial Sequence
  Synthetic: non target strand CCR5
catcaccacagccaggatccatgcaaacacagcatggacgacagccaggtacctaaaaagaattcgagctcggcg

SEQ ID NO: 472 - DNA, 75 bp, Artificial Sequence; identical to SEQ ID NO: 468
  Synthetic: target strand J3

SEQ ID NO: 473 - DNA, 75 bp, Artificial Sequence; identical to SEQ ID NO: 469
  Synthetic: non target strand J3

SEQ ID NO: 474 - DNA, 75 bp, Artificial Sequence; identical to SEQ ID NO: 470
  Synthetic: target strand CCR5 Site

SEQ ID NO: 475 - DNA, 52 bp, Artificial Sequence
  Synthetic: Forward primer to amplify Hsa07 dual-target from human genomic DNA
cactctttccctacacgacgctcttccgatctttcctccctaacctccacct

SEQ ID NO: 476 - DNA, 48 bp, Artificial Sequence
  Synthetic: Reverse primer to amplify Hsa07 dual-target from human genomic DNA
ggagttcagacgtgtgctcttccgatcttaaagagcccaaccagatgc

SEQ ID NO: 477 - DNA, 45 bp, Artificial Sequence
  Synthetic: Forward oligo, J3 target sequence for cloning into pACYC-Duet1
gatccatgccagtgataagtggaatgccatgtgggctgtcaaaag

SEQ ID NO: 478 - DNA, 45 bp, Artificial Sequence
  Synthetic: Reverse oligo, J3 target sequence for cloning into pACYC-Duet1
aattcttttgacagcccacatggcattccacttatcactggcatg

SEQ ID NO: 479 - DNA, 100 bp, Artificial Sequence
  Synthetic: Forward oligo, J3-15bp-L3 target sequences for cloning into pACYC-Duet1
aattcttttgacagcccacatggcattccacttatcactggcatcctaggcctctcgagatgagtggcagatatagcctggtggttcaggcggcgcatgc

SEQ ID NO: 480 - DNA, 99 bp, Artificial Sequence
  Synthetic: Reverse oligo, J3-15bp-L3 target sequences for cloning into pACYC-Duet1
tcagcatgcgccgcctgaaccaccaggctatatctgccactcatctcgagaggcctaggatgccagtgataagtggaatgccatgtgggctgtcaaaag

SEQ ID NO: 481 - DNA, 4068 bp, Artificial Sequence
  Synthetic: Complete vector sequence, J3 target sequence in pACYC-Duet1
taatacgactcactataggggaattgtgagcggataacaattcccctgtagaaataattttgtttaactttaataaggagatataccatgggcagcagccatcaccatcatcaccacagccaggatccatgccagtgataagtggaatgccatgtgggctgtcaaaagaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgtcagcattgcatattgtcagacgactcctgcattaggaaat

SEQ ID NO: 482 - DNA, 3769 bp, Artificial Sequence
  Synthetic: Complete vector sequence, J3-15bp-L3 target sequences in pACYC-Duet1
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctaggcctctcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 483 - DNA, 3784 bp, Artificial Sequence
  Synthetic: Complete vector sequence, J3-30bp-L3 target sequences in pACYC-Duet1
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctagcccttccactctttcgaaactcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 484 - DNA, 5815 bp, Artificial Sequence
  Synthetic: Complete vector sequence, multi-target plasmid
taatacgactcactataggggaattgtgagcggataacaattcccctgtagaaataattttgtttaactttaataaggagatataccatgggcagcagccatcaccatcatcaccacagccaggatccgaattcgagctctctaggtacctggctgtcgtccatgctgtgtttgcatcctaggcctctcgagcctaggcctctcgagatgtgtgatcacttgggtggtggctgtgtttgcgtgcttgacagcccacatggcattccacttatcactggcatcctagcccttccactctttcgaaactcgagatgagtggcagatatagcctggtggttcaggcggcgcctgggcctgaaaggcctccagctctgcctgcccgcttactgcctcagcttccctgccccacaaagggcctgaggtgctgcctgggcatgtgtaaaggtgtccaggcaaagccactgaggtccgggtgacagtgcttcggcaggctgacagccaggtgactgaagtctgtgcggcaacctacatgatggggaatgagttgtgtgaattatggtggtgctacaaacaagctcatctttggaactggcactctgcttgctgtccagccaagtacgtaagtagtggcatgtgtcaggtggattctgtatacaattatgtgtctgccggtccaaatgccttcttctataggccatgtttttatttctcttccaaaagagactccagagccatccttgggaagagtgctgagatcactgtgggaattcaggaaacacacctcttgtctttggaaagggcacaagactttctgtgattgcaagtaagtgtttctagccatccttgattttgatcagccaaggcaggatcccaggagacagagcagtagccactttgagtgaatttcccaggaggtgctcctgccaaggcccataccttcaaggaaaattaaggcaaatagaaaagactgtgtaacaccaatgcaggcaaatcaacctttggggatgggactacgctcactgtgaagccaagtaagttgtgttcttctttgcctaggccttcagggacatcaccaggttgtagaagttgacaggcagtgccatgggggcaacagccaaaataggggggtaatgatgtaggggccaagcagtgcccagctgggggtcaatagtttctgtcacatcagctccactttcagtgaaagcatcacttgggattaatatggggatgcagcattatgatgtgggtcaaggaattaagttagggaatggcgaagccgaaatgatcttttcaagttaaattttatgccttttatttcttaaacaaatgtatgattacatcaaggcttcaaaaatactcacatggctatgttttagccccaacagagccagaatgtgaaaagcaatttcagccttattttattcccatcaattgagaaaccattatgaagaagagagtccatatttcaatttccaagagctgaggcaaggcaaggctgctgcagcctcccctggctgtgcacattccctcctgctccccagagactgcctccgccatcccacagatgatggatcttcagtgggttctcttgggctctaggtcccaaaaggccacactggtgtgcctggccacaggcttctaccccgaccacgtggagctgagctggtgggtgaatgggaaggaggtgcacagtggggtcagcacagacccgcagctgtgctccctcgctccttcctctgcattgcccctcttctccctctccaaacagagggaactctcctacccccaaggaggtgaaagctgctaccacctctgtgcccccccggcaatgccaacatatctgggatcaaagctatctatataaagtccttgattctgtgtgggttcaaacacatttcaaagcttcaggatcctgaaaggttttgctctacttcctgaagacctgaacaccgccctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 485 - DNA, 95 bp, Artificial Sequence
  Synthetic: Target Hsa01
gggcctgaaaggcctccagctctgcctgcccgcttactgcctcagcttccctgccccacaaagggcctgaggtgctgcctgggcatgtgtaaagg

SEQ ID NO: 486 - DNA, 95 bp, Artificial Sequence
  Synthetic: Target Hsa02
caggcaaagccactgaggtccgggtgacagtgcttcggcaggctgacagccaggtgactgaagtctgtgcggcaacctacatgatggggaatgag

SEQ ID NO: 487 - DNA, 100 bp, Artificial Sequence
  Synthetic: Target Hsa03
gtgaattatggtggtgctacaaacaagctcatctttggaactggcactctgcttgctgtccagccaagtacgtaagtagtggcatgtgtcaggtggattc

SEQ ID NO: 488 - DNA, 100 bp, Artificial Sequence
  Synthetic: Target Hsa04
tacaattatgtgtctgccggtccaaatgccttcttctataggccatgtttttatttctcttccaaaagagactccagagccatccttgggaagagtgctg

SEQ ID NO: 489 - DNA, 100 bp, Artificial Sequence
  Synthetic: Target Hsa05
cactgtgggaattcaggaaacacacctcttgtctttggaaagggcacaagactttctgtgattgcaagtaagtgtttctagccatccttgattttgatca

SEQ ID NO: 490 - DNA, 100 bp, Artificial Sequence
  Synthetic: Target Hsa06
aggcaggatcccaggagacagagcagtagccactttgagtgaatttcccaggaggtgctcctgccaaggcccataccttcaaggaaaattaaggcaaata

SEQ ID NO: 491 - DNA, 100 bp, Artificial Sequence
  Synthetic: Target Hsa07
agactgtgtaacaccaatgcaggcaaatcaacctttggggatgggactacgctcactgtgaagccaagtaagttgtgttcttctttgcctaggccttcag

SEQ ID NO: 492 - DNA, 100 bp, Artificial Sequence
  Synthetic: Target Hsa08
atcaccaggttgtagaagttgacaggcagtgccatgggggcaacagccaaaataggggggtaatgatgtaggggccaagcagtgcccagctgggggtcaa

SEQ ID NO: 493 - DNA, 100 bp, Artificial Sequence
  Synthetic: Target Hsa09
ttctgtcacatcagctccactttcagtgaaagcatcacttgggattaatatggggatgcagcattatgatgtgggtcaaggaattaagttagggaatggc

SEQ ID NO: 494 - DNA, 100 bp, Artificial Sequence
  Synthetic: Target Hsa10
ccgaaatgatcttttcaagttaaattttatgccttttatttcttaaacaaatgtatgattacatcaaggcttcaaaaatactcacatggctatgttttag

SEQ ID NO: 495 - DNA, 115 bp, Artificial Sequence
  Synthetic: Target Hsa11
tgctccctcgctccttcctctgcattgcccctcttctccctctccaaacagagggaactctcctacccccaaggaggtgaaagctgctaccacctctgtgcccccccggcaatgc

SEQ ID NO: 496 - DNA, 105 bp, Artificial Sequence
  Synthetic: Target Hsa12
aacagagccagaatgtgaaaagcaatttcagccttattttattcccatcaattgagaaaccattatgaagaagagagtccatatttcaatttccaagagctgagg

SEQ ID NO: 497 - DNA, 110 bp, Artificial Sequence
  Synthetic: Target Hsa13
gcaaggctgctgcagcctcccctggctgtgcacattccctcctgctccccagagactgcctccgccatcccacagatgatggatcttcagtgggttctcttgggctctag

SEQ ID NO: 498 - DNA, 110 bp, Artificial Sequence
  Synthetic: Target Hsa14
caaaaggccacactggtgtgcctggccacaggcttctaccccgaccacgtggagctgagctggtgggtgaatgggaaggaggtgcacagtggggtcagcacagacccgca

SEQ ID NO: 499 - DNA, 115 bp, Artificial Sequence; identical to SEQ ID NO: 495
  Synthetic: Target Hsa15

SEQ ID NO: 500 - DNA, 115 bp, Artificial Sequence
  Synthetic: Target Hsa16
atatctgggatcaaagctatctatataaagtccttgattctgtgtgggttcaaacacatttcaaagcttcaggatcctgaaaggttttgctctacttcctgaagacctgaacacc

SEQ ID NO: 501 - RNA, 21 nt, Artificial Sequence
  Synthetic: sgRNA-J3 spacer sequence
gugauaaguggaaugccaugu

SEQ ID NO: 502 - DNA, 4008 bp, Artificial Sequence
  Synthetic: Complete vector sequence, pACYC-Duet1 non-target plasmid
taatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 503 - DNA, 3784 bp, Artificial Sequence
  Synthetic: Complete vector sequence, J3-30bp-L3 target plasmid, J3 PAM mutant
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcggcctagcccttccactctttcgaaactcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 504 - DNA, 3784 bp, Artificial Sequence
  Synthetic: Complete vector sequence, J3-30bp-L3 target plasmid, L3 PAM mutant
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctagcccttccactctttcgaaactcgagccgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 505 - DNA, 3784 bp, Artificial Sequence
  Synthetic: Complete vector sequence, J3-30bp-L3 target plasmid, J3/L3 PAM mutants
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcggcctagcccttccactctttcgaaactcgagccgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 506 - DNA, 3784 bp, Artificial Sequence
  Synthetic: Complete vector sequence, J3-30bp-L3 target plasmid, J3 spacer mutant
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatgtgacccatcctagcccttccactctttcgaaactcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 507 - DNA, 3784 bp, Artificial Sequence
  Synthetic: Complete vector sequence, J3-30bp-L3 target plasmid, L3 spacer mutants
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctagcccttccactctttcgaaactcgagatgtcaccgagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 508 - DNA, 3784 bp, Artificial Sequence
  Synthetic: Complete vector sequence, J3-30bp-L3 target plasmid, J3/L3 spacer mutants
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatgtgacccatcctagcccttccactctttcgaaactcgagatgtcaccgagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 509 - DNA, 4068 bp, Artificial Sequence; identical to SEQ ID NO: 481
  Synthetic: Complete vector sequence, J3-only target plasmid

SEQ ID NO: 510 - DNA, 4047 bp, Artificial Sequence
  Synthetic: Complete vector sequence, L3-only target plasmid
taatacgactcactataggggaattgtgagcggataacaattcccctgtagaaataattttgtttaactttaataaggagatataccatgggcagcagccatcaccatcatcaccacagccaggatccatgcgccgcctgaaccaccaggctatatctgccactcatgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 511 - RNA, 61 nt, Artificial Sequence
  Synthetic: crRNA sequence, target Hsa01-1
auaaaccgcgggcaggcagagcuggaggccuuucaggcccgaguuccccgcgccagcgggg

SEQ ID NO: 512 - RNA, 61 nt, Artificial Sequence
  Synthetic: crRNA sequence, target Hsa01-2
auaaaccgggccugaggugcugccugggcauguguaaagggaguuccccgcgccagcgggg

SEQ ID NO: 513 - RNA, 61 nt, Artificial Sequence
  Synthetic: crRNA sequence, target Hsa02-1
auaaaccgcacugucacccggaccucaguggcuuugccuggaguuccccgcgccagcgggg

SEQ ID NO: 514 - RNA, 61 nt, Artificial Sequence
  Synthetic: crRNA sequence, target Hsa02-2
auaaaccgucugugcggcaaccuacaugauggggaaugaggaguuccccgcgccagcgggg

SEQ ID NO: 515 - RNA, 61 nt, Artificial Sequence
  Synthetic: crRNA sequence, target Hsa03-1
auaaaccgaugagcuuguuuguagcaccaccauaauucacgaguuccccgcgccagcgggg

SEQ ID NO: 516 - RNA, 61 nt, Artificial Sequence
  Synthetic: crRNA sequence, target Hsa03-2
auaaaccguacguaaguaguggcaugugucagguggauucgaguuccccgcgccagcgggg

SEQ ID NO: 517 - RNA, 61 nt, Artificial Sequence
  Synthetic: crRNA sequence, target Hsa04-1
auaaaccgaaggcauuuggaccggcagacacauaauuguagaguuccccgcgccagcgggg

SEQ ID NO: 518 - RNA, 61 nt, Artificial Sequence
  Synthetic: crRNA sequence, target Hsa04-2
auaaaccgagacuccagagccauccuugggaagagugcuggaguuccccgcgccagcgggg

SEQ ID NO: 519 - RNA, 61 nt, Artificial Sequence
  Synthetic: crRNA sequence, target Hsa05-1
auaaaccgacaagagguguguuuccugaauucccacaguggaguuccccgcgccagcgggg

SEQ ID NO: 520 - RNA, 61 nt, Artificial Sequence
  Synthetic: crRNA sequence, target Hsa05-2
auaaaccguaaguguuucuagccauccuugauuuugaucagaguuccccgcgccagcgggg

SEQ ID NO: 521 - RNA, 61 nt, Artificial Sequence
  Synthetic: crRNA sequence, target Hsa06-1
auaaaccguggcuacugcucugucuccugggauccugccugaguuccccgcgccagcgggg

SEQ ID NO: 522 - RNA, 61 nt, Artificial Sequence
  Synthetic: crRNA sequence, target Hsa06-2
auaaaccggcccauaccuucaaggaaaauuaaggcaaauagaguuccccgcgccagcgggg

SEQ ID NO: 523 - RNA, 61 nt, Artificial Sequence
  Synthetic: crRNA sequence, target Hsa07-1
auaaaccgguugauuugccugcauugguguuacacagucugaguuccccgcgccagcgggg

SEQ ID NO: 524 - RNA, 61 nt, Artificial Sequence
  Synthetic: crRNA sequence, target Hsa07-2
auaaaccguaaguuguguucuucuuugccuaggccuucaggaguuccccgcgccagcgggg

SEQ ID NO: 525 - RNA, 61 nt, Artificial Sequence
  Synthetic: crRNA sequence, target Hsa08-1
auaaaccggcacugccugucaacuucuacaaccuggugaugaguuccccgcgccagcgggg

SEQ ID NO: 526 - RNA, 61 nt, Artificial Sequence
  Synthetic: crRNA sequence, target Hsa08-2
auaaaccguaggggccaagcagugcccagcugggggucaagaguuccccgcgccagcgggg

SEQ ID NO: 527 - RNA, 61 nt, Artificial Sequence
  Synthetic: crRNA sequence, target Hsa09-1
auaaaccgcuuucacugaaaguggagcugaugugacagaagaguuccccgcgccagcgggg

SEQ ID NO: 528 - RNA, 61 nt, Artificial Sequence
  Synthetic: crRNA sequence, target Hsa09-2
auaaaccgaugugggucaaggaauuaaguuagggaauggcgaguuccccgcgccagcgggg

SEQ ID NO: 529 - RNA, 61 nt, Artificial Sequence
  Synthetic: crRNA sequence, target Hsa10-1
auaaaccggcauaaaauuuaacuugaaaagaucauuucgggaguuccccgcgccagcgggg

SEQ ID NO: 530 - RNA, 61 nt, Artificial Sequence
  Synthetic: crRNA sequence, target Hsa10-2
auaaaccggcuucaaaaauacucacauggcuauguuuuaggaguuccccgcgccagcgggg

SEQ ID NO: 531 - RNA, 61 nt, Artificial Sequence
  Synthetic: crRNA sequence, target Hsa11-1
auaaaccgaggggcaaugcagaggaaggagcgagggagcagaguuccccgcgccagcgggg

SEQ ID NO: 532 - RNA, 61 nt, Artificial Sequence
  Synthetic: crRNA sequence, target Hsa11-2
auaaaccggaggugaaagcugcuaccaccucugugcccccgaguuccccgcgccagcgggg

SEQ ID NO: 533 - RNA, 61 nt, Artificial Sequence
  Synthetic: crRNA sequence, target Hsa12-1
auaaaccggcugaaauugcuuuucacauucuggcucuguugaguuccccgcgccagcgggg

SEQ ID NO: 534 - RNA, 61 nt, Artificial Sequence
  Synthetic: crRNA sequence, target Hsa12-2
auaaaccgagaguccauauuucaauuuccaagagcugagggaguuccccgcgccagcgggg

SEQ ID NO: 535 - RNA, 61 nt, Artificial Sequence
  Synthetic: crRNA sequence, target Hsa13-1
auaaaccgugcacagccaggggaggcugcagcagccuugcgaguuccccgcgccagcgggg

SEQ ID NO: 536 - RNA, 61 nt, Artificial Sequence
  Synthetic: crRNA sequence, target Hsa13-2
auaaaccgauggaucuucaguggguucucuugggcucuaggaguuccccgcgccagcgggg

SEQ ID NO: 537 - RNA, 61 nt, Artificial Sequence
  Synthetic: crRNA sequence, target Hsa14-1
auaaaccgccuguggccaggcacaccaguguggccuuuuggaguuccccgcgccagcgggg

SEQ ID NO: 538 - RNA, 61 nt, Artificial Sequence
  Synthetic: crRNA sequence, target Hsa14-2
auaaaccggaggugcacaguggggucagcacagacccgcagaguuccccgcgccagcgggg

SEQ ID NO: 539 - RNA, 61 nt, Artificial Sequence; identical to SEQ ID NO: 531
  Synthetic: crRNA sequence, target Hsa15-1

SEQ ID NO: 540 - RNA, 61 nt, Artificial Sequence
  Synthetic: crRNA sequence, target Hsa15-2
auaaaccgcugcuaccaccucugugcccccccggcaaugcgaguuccccgcgccagcgggg

SEQ ID NO: 541 - RNA, 61 nt, Artificial Sequence
  Synthetic: crRNA sequence, target Hsa16-1
auaaaccggacuuuauauagauagcuuugaucccagauaugaguuccccgcgccagcgggg

SEQ ID NO: 542 - RNA, 61 nt, Artificial Sequence
  Synthetic: crRNA sequence, target Hsa16-2
auaaaccgguuuugcucuacuuccugaagaccugaacaccgaguuccccgcgccagcgggg

SEQ ID NO: 543 - DNA, 97 bp, Artificial Sequence
  Synthetic: Oligo A
accgatgagcttgtttgtagcaccaccataattcacgagttccccgcgccagcggggataaaccgtacgtaagtagtggcatgtgtcaggtggattc

SEQ ID NO: 544 - DNA, 97 bp, Artificial Sequence
  Synthetic: Oligo B
actcgaatccacctgacacatgccactacttacgtacggtttatccccgctggcgcggggaactcgtgaattatggtggtgctacaaacaagctcat

SEQ ID NO: 545 - DNA, 97 bp, Artificial Sequence
  Synthetic: Oligo C
accgaaggcatttggaccggcagacacataattgtagagttccccgcgccagcggggataaaccgagactccagagccatccttgggaagagtgctg

SEQ ID NO: 546 - DNA, 97 bp, Artificial Sequence
  Synthetic: Oligo D
actccagcactcttcccaaggatggctctggagtctcggtttatccccgctggcgcggggaactctacaattatgtgtctgccggtccaaatgcctt

SEQ ID NO: 547 - DNA, 97 bp, Artificial Sequence
  Synthetic: Oligo E
accgacaagaggtgtgtttcctgaattcccacagtggagttccccgcgccagcggggataaaccgtaagtgtttctagccatccttgattttgatca

SEQ ID NO: 548 - DNA, 97 bp, Artificial Sequence
  Synthetic: Oligo F
actctgatcaaaatcaaggatggctagaaacacttacggtttatccccgctggcgcggggaactccactgtgggaattcaggaaacacacctcttgt

SEQ ID NO: 549 - DNA, 97 bp, Artificial Sequence
  Synthetic: Oligo G
accgtggctactgctctgtctcctgggatcctgcctgagttccccgcgccagcggggataaaccggcccataccttcaaggaaaattaaggcaaata

SEQ ID NO: 550 - DNA, 97 bp, Artificial Sequence
  Synthetic: Oligo H
actctatttgccttaattttccttgaaggtatgggccggtttatccccgctggcgcggggaactcaggcaggatcccaggagacagagcagtagcca

SEQ ID NO: 551 - DNA, 97 bp, Artificial Sequence
  Synthetic: Oligo I
accggttgatttgcctgcattggtgttacacagtctgagttccccgcgccagcggggataaaccgtaagttgtgttcttctttgcctaggccttcag

SEQ ID NO: 552 - DNA, 97 bp, Artificial Sequence
  Synthetic: Oligo J
actcctgaaggcctaggcaaagaagaacacaacttacggtttatccccgctggcgcggggaactcagactgtgtaacaccaatgcaggcaaatcaac

SEQ ID NO: 553 - DNA, 97 bp, Artificial Sequence
  Synthetic: Oligo K
accggcactgcctgtcaacttctacaacctggtgatgagttccccgcgccagcggggataaaccgtaggggccaagcagtgcccagctgggggtcaa

SEQ ID NO: 554 - DNA, 97 bp, Artificial Sequence
  Synthetic: Oligo L
actcttgacccccagctgggcactgcttggcccctacggtttatccccgctggcgcggggaactcatcaccaggttgtagaagttgacaggcagtgc

SEQ ID NO: 555 - DNA, 97 bp, Artificial Sequence
  Synthetic: Oligo M
accgctttcactgaaagtggagctgatgtgacagaagagttccccgcgccagcggggataaaccgatgtgggtcaaggaattaagttagggaatggc

SEQ ID NO: 556 - DNA, 97 bp, Artificial Sequence
  Synthetic: Oligo N
actcgccattccctaacttaattccttgacccacatcggtttatccccgctggcgcggggaactcttctgtcacatcagctccactttcagtgaaag

SEQ ID NO: 557 - DNA, 97 bp, Artificial Sequence
  Synthetic: Oligo O
accggcataaaatttaacttgaaaagatcatttcgggagttccccgcgccagcggggataaaccggcttcaaaaatactcacatggctatgttttag

SEQ ID NO: 558 - DNA, 97 bp, Artificial Sequence
  Synthetic: Oligo P
actcctaaaacatagccatgtgagtatttttgaagccggtttatccccgctggcgcggggaactcccgaaatgatcttttcaagttaaattttatgc

SEQ ID NO: 559 - DNA, 52 bp, Artificial Sequence
  Synthetic: Oligo Q
cactctttccctacacgacgctcttccgatctagcctggaaagacacaaagc

SEQ ID NO: 560 - DNA, 48 bp, Artificial Sequence
  Synthetic: Oligo R
ggagttcagacgtgtgctcttccgatctcagccatcctttccacctaa

SEQ ID NO: 561 - DNA, 52 bp, Artificial Sequence
  Synthetic: Oligo S
cactctttccctacacgacgctcttccgatctatgctgcaggctttatgctt

SEQ ID NO: 562 - DNA, 48 bp, Artificial Sequence
  Synthetic: Oligo T
ggagttcagacgtgtgctcttccgatctttaggcctgcctgacttctc

SEQ ID NO: 563 - DNA, 53 bp, Artificial Sequence
  Synthetic: Oligo U
cactctttccctacacgacgctcttccgatctgggaagaagaccaacaagagg

SEQ ID NO: 564 - DNA, 48 bp, Artificial Sequence
  Synthetic: Oligo V
ggagttcagacgtgtgctcttccgatctttcaagggaagaagccattg

SEQ ID NO: 565 - DNA, 52 bp, Artificial Sequence
  Synthetic: Oligo W
cactctttccctacacgacgctcttccgatctaaggcaggaattggatgaaa

SEQ ID NO: 566 - DNA, 48 bp, Artificial Sequence
  Synthetic: Oligo X
ggagttcagacgtgtgctcttccgatctaacctgagatgactgcccat

SEQ ID NO: 567 - DNA, 52 bp, Artificial Sequence; identical to SEQ ID NO: 475
  Synthetic: Oligo Y

SEQ ID NO: 568 - DNA, 48 bp, Artificial Sequence; identical to SEQ ID NO: 476
  Synthetic: Oligo Z

SEQ ID NO: 569 - DNA, 52 bp, Artificial Sequence
  Synthetic: Oligo A2
cactctttccctacacgacgctcttccgatctgtctcagccttagccctgtg

SEQ ID NO: 570 - DNA, 48 bp, Artificial Sequence
  Synthetic: Oligo B2
ggagttcagacgtgtgctcttccgatctcccactgcaagtacaagggt

SEQ ID NO: 571 - DNA, 51 bp, Artificial Sequence
  Synthetic: Oligo C2
cactctttccctacacgacgctcttccgatctggatgcggaacccaaatta

SEQ ID NO: 572 - DNA, 48 bp, Artificial Sequence
  Synthetic: Oligo D2
ggagttcagacgtgtgctcttccgatcttagtcttctccctcgctccc

SEQ ID NO: 573 - DNA, 52 bp, Artificial Sequence
  Synthetic: Oligo E2
cactctttccctacacgacgctcttccgatcttgcagcattatgatgtgggt

SEQ ID NO: 574 - DNA, 49 bp, Artificial Sequence
  Synthetic: Oligo F2
ggagttcagacgtgtgctcttccgatctcaacctttagcatcactggct

SEQ ID NO: 575 - DNA, 57 bp, Artificial Sequence
  Synthetic: Oligo G2
  misc_feature (25)..(32): n is a, c, g, or t
caagcagaagacggcatacgagatnnnnnnnngtgactggagttcagacgtgtgctc

SEQ ID NO: 576 - DNA, 58 bp, Artificial Sequence
  Synthetic: Oligo H2
  misc_feature (30)..(37): n is a, c, g, or t
aatgatacggcgaccaccgagatctacacnnnnnnnnacactctttccctacacgacg

SEQ ID NO: 577 - protein, 210 aa, Artificial Sequence; identical to SEQ ID NO: 399
  Synthetic: NSL-Cas6

SEQ ID NO: 578 - protein, 366 aa, Artificial Sequence
  Synthetic: cpCas7 V1
MKDGFLQPSIQAFNQYWDRVANGYGLNGAAAQFSLSDVDPITAQVKQMPTLEQLKSWVRNNGEAGSMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKA

SEQ ID NO: 579 - protein, 366 aa, Artificial Sequence
  Synthetic: cpCas7 V2
MDPITAQVKQMPTLEQLKSWVRNNGEAGSMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDV

SEQ ID NO: 580 - protein, 583 aa, Artificial Sequence
  Synthetic: Fok1
MFLSMVSKIRTFGWVQNPGKFENLKRVVQVFDRNSKVHNEVKNIKIPTLVKESKIQKELVAIMNQHDLIYTYKELVGTGTSIRSEAPCDAIIQATIADQGNKKGYIDNWSSDGFLRWAHALGFIEYINKSDSFVITDVGLAYSKSADGSAIEKEILIEAISSYPPAIRILTLLEDGQHLTKFDLGKNLGFSGESGFTSLPEGILLDTLANAMPKDKGEIRNNWEGSSDKYARMIGGWLDKLGLVKQGKKEFIIPTLGKPDNKEFISHAFKITGEGLKVLRRAKGSTKFTRVPKRVYWEMLATNLTDKEYVRTRRALILEILIKAGSLKIEQIQDNLKKLGFDEVIETIENDIKGLINTGIFIEIKGRFYQLKDHILQFVIPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 581 - protein, 196 aa, Artificial Sequence
  Synthetic: Fok1 sharkey
QLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 582 - protein, 30 aa, Artificial Sequence; identical to SEQ ID NO: 425
  Synthetic: Linker

SEQ ID NO: 583 - protein, 6 aa, Artificial Sequence
  Synthetic: Hexahistidine tag
HHHHHH

SEQ ID NO: 584 - protein, 367 aa, Artificial Sequence; identical to SEQ ID NO: 423
  Synthetic: MBP

SEQ ID NO: 585 - protein, 7 aa, Artificial Sequence
  Synthetic: TEV
ENLYFQS

SEQ ID NO: 586 - protein, 7 aa, Artificial Sequence
  Synthetic: NLS
PKKKRKV

SEQ ID NO: 587 - protein, 738 aa, Artificial Sequence
  Synthetic: NLS-Fok1_Linker-Cas8
SNMPKKKRKVQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFSGSETPGTSESATPESGGSGSSGGSGSSGGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 588 - protein, 330 aa, Artificial Sequence
  Synthetic: CasB-CasB
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 589 - protein, 10 aa, Artificial Sequence
  Synthetic: Linker
SGGSGGSGGS

SEQ ID NO: 590 - protein, 229 aa, Artificial Sequence [sequence omitted]

SEQ ID NO: 591 - protein, 9 aa, Artificial Sequence
  Synthetic: Linker
GGSGGSGGS

SEQ ID NO: 592 - protein, 568 aa, Artificial Sequence
  Synthetic: rAPOBEC1_CasB-CasB
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 593 - protein, 731 aa, Artificial Sequence
  Synthetic: Cas8_rAPOBEC1
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 594 - protein, 700 aa, Artificial Sequence
  Synthetic: Cas8_AID
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGL

SEQ ID NO: 595 - protein, 710 aa, Artificial Sequence
  Synthetic: Cas8_PmCDA1
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 596 - protein, 738 aa, Artificial Sequence
  Synthetic: Cas8_Human APOBEC1
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 597 - protein, 875 aa, Artificial Sequence
  Synthetic: Cas8_APOBEC3F
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 598 - protein, 886 aa, Artificial Sequence
  Synthetic: Cas8_APOBEC3G
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 599 - protein, 157 aa, Artificial Sequence
  Synthetic: PvuIIHIFIT46G
MSHPDLNKLLELWPHIQEYQDLALKHGINDIFQDNGGKLLQVLLIGGLTVLPGREGNDAVDNAGQEYELKSINIDLTKGFSTHHHMNPVIIAKYRQVPWIFAIYRGIAIEAIYRLEPKDLEFYYDKWERKWYSDGHKDINNPKIPVKYVMEHGTKIY

SEQ ID NO: 600 - protein, 316 aa, Artificial Sequence
  Synthetic: PvuIIsinglechainT46G
SHPDLNKLLELWPHIQEYQDLALKHGINDIFQDNGGKLLQVLLIGGLTVLPGREGNDAVDNAGQEYELKSINIDLTKGFSTHHHMNPVIIAKYRQVPWIFAIYRGIAIEAIYRLEPKDLEFYYDKWERKWYSDGHKDINNPKIPVKYVMEHGTKIYGSGGSHPDLNKLLELWPHIQEYQDLALKHGINDIFQDNGGKLLQVLLIGGLTVLPGREGNDAVDNAGQEYELKSINIDLTKGFSTHHHMNPVIIAKYRQVPWIFAIYRGIAIEAIYRLEPKDLEFYYDKWERKWYSDGHKDINNPKIPVKYVMEHGTKIY

SEQ ID NO: 601 - protein, 169 aa, Artificial Sequence
  Synthetic: I-TevI1-169Q158R
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIRTSAYTCSKCRN

SEQ ID NO: 602 - protein, 169 aa, Artificial Sequence
  Synthetic: I-TevI1-169
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRN

SEQ ID NO: 603 - protein, 238 aa, Artificial Sequence
  Synthetic: BcnI singlechain
MKIWSKEEVVNKLHEIKNKGYLSVPTDMFRTDDGVVGQILERQFGVQENNITLGDLGEFELKGMRNRKAKSNLTLFHKKPVAGQTVIQIFNRFGYVKPSSRNPEVMKKKLFTTIKGGRLNNLGLTLNAKHASEINLYYQDEYLSTWDLNLSKIEKLVLVFAETIGRANSPEEQFHFTKAYMLTEINDITSLINDGVLVMDLCIDQDLSKSKGPHDRGPHLRIPISKLDKLYRNIERLL

SEQ ID NO: 604 - protein, 249 aa, Artificial Sequence
  Synthetic: MvaI singlechain
MKSMSEYLNLLKEAIQNVVDGGWHETKRKGNTGIGKTFEDLLEKEEDNLDAPDFHDIEIKTHETAAKSLLTLFTKSPTNPRGANTMLRNRYGKKDEYGNNILHQTVSGNRKTNSNSYNYDFKIDIDWESQVVRLEVFDKQDIMIDNSVYWSFDSLQNQLDKKLKYIAVISAESKIENEKKYYKYNSANLFTDLTVQSLCRGIENGDIKVDIRIGAYHSGKKKGKTHDHGTAFRINMEKLLEYGEVKVIV

SEQ ID NO: 605 - protein, 260 aa, Artificial Sequence
  Synthetic: DNaseI
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 606 - protein, 888 aa, Artificial Sequence; identical to SEQ ID NO: 21
  Synthetic: Cas3

SEQ ID NO: 607 - protein, 267 aa, Artificial Sequence
  Synthetic: S1Aspergillus
WGNLGHETVAYIAQSFVASSTESFCQNILGDDSTSYLANVATWADTYKYTDAGEFSKPYHFIDAQDNPPQSCGVDYDRDCGSAGCSISAIQNYTNILLESPNGSEALNALKFVVHIIGDIHQPLHDENLEAGGNGIDVTYDGETTNLHHIWDTNMPEEAAGGYSLSVAKTYADLLTERIKTGTYSSKKDSWTDGIDIKDPVSTSMIWAADANTYVCSTVLDDGLAYINSTDLSGEYYDKSQPVFEELIAKAGYRLAAWLDLIASQPS

SEQ ID NO: 608 - protein, 568 aa, Artificial Sequence; identical to SEQ ID NO: 592
  Synthetic: rAPOBEC1

SEQ ID NO: 609 - protein, 537 aa, Artificial Sequence
  Synthetic: AID
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGGSGGSGGSMDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGL

SEQ ID NO: 610 - protein, 547 aa, Artificial Sequence
  Synthetic: CPmCDA1
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGGSGGSGGSMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 611 - protein, 575 aa, Artificial Sequence
  Synthetic: Human APOBEC1
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 612 - protein, 712 aa, Artificial Sequence
  Synthetic: Human APOBEC3F
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILEGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 613 - protein, 723 aa, Artificial Sequence
  Synthetic: APOBEC3G
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQENGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 614 - protein, 11 aa, Artificial Sequence
  Synthetic: VP16
DALDDFDLDML

SEQ ID NO: 615 - protein, 50 aa, Artificial Sequence
  Synthetic: VP64
DALDDFDLDMLGSDALDDFDLDMLGSDALDDFDLDMLGSDALDDFDLDML

SEQ ID NO: 616 - protein, 366 aa, Artificial Sequence; identical to SEQ ID NO: 579
  Synthetic: cpCas7 V2

SEQ ID NO: 617 - RNA, 92 nt, Artificial Sequence
  Synthetic: tracrRNA (RNA)
agcauagcaaguuaaaauaaggcuaguccguuaucaacuugaaaaaguggcaccgagucggugcuuaaguucacugccguauaggcagcuuu

SEQ ID NO: 618 - DNA, 92 bp, Artificial Sequence
  Synthetic: tracrRNA (DNA)
agcatagcaagttaaaataaggctagtccgttatcaacttgaaaaagtggcaccgagtcggtgcttaagttcactgccgtataggcagcttt

SEQ ID NO: 619 - RNA, 36 nt, Artificial Sequence
  Synthetic: CXCR4 targeting spacer (RNA)
gaaccagcgguuaccauggaguuuuagagcuaugcu

SEQ ID NO: 620 - DNA, 36 bp, Artificial Sequence
  Synthetic: CXCR4 targeting spacer (DNA)
gaaccagcggttaccatggagttttagagctatgct

SEQ ID NO: 621 - DNA, 918 bp, Escherichia coli K-12 MG1655
  misc_feature (1)..(918): Cas1
atgacctggcttccccttaatcccattccactcaaagatcgcgtctccatgatctttctgcaatatgggcagatcgatgtaatagatggcgcgtttgtacttatcgacaagacagggatccgcactcatattcctgttggctcggttgcctgcatcatgctggaacctggtacacgggtttcgcatgcagctgtacgcctggctgcgcaagttggaacattgttggtatgggtgggggaagcgggcgttcgtgtttatgcttctggtcagcctggaggtgcgcgttcagataagctgctctatcaggcaaaacttgctctggatgaagatttgcgtctgaaggtcgtacgtaaaatgtttgaacttcggtttggagaacctgcgcctgcccggcgctccgtagagcaactcagaggtatagaaggcagtcgcgtgcgggcaacctacgcacttctggcgaagcaatacggcgtgacatggaatggacgtcgctacgatccgaaagactgggaaaagggcgatacgatcaaccaatgcattagcgctgcaacttcctgtttatacggcgtaactgaagcggcgatacttgcagctggttatgcaccagctattgggtttgtgcatacaggaaagcctctttcctttgtttacgatattgcagacatcattaaatttgacactgttgtaccgaaagcttttgagatagcgcgtcgtaaccctggtgagccggaccgggaagtccgtttggcgtgcagggatatttttcgcagtagtaaaacattagccaaattgattccgcttatagaggacgtgcttgccgctggagaaatacaaccgccggccccacctgaagatgcacagcctgttgccattccgcttcctgtttcactgggagatgcaggccatcggagtagctga

SEQ ID NO: 622 - DNA, 1092 bp, Escherichia coli K-12 MG1655; identical to SEQ ID NO: 3
  misc_feature (1)..(1092): Cas7

SEQ ID NO: 623 - DNA, 675 bp, Escherichia coli K-12 MG1655; identical to SEQ ID NO: 9
  misc_feature (1)..(675): Cas5

SEQ ID NO: 624 - DNA, 2667 bp, Escherichia coli K-12 MG1655
  misc_feature (1)..(2667): Cas3
atggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatcttacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttatttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataa

SEQ ID NO: 625 - DNA, 97 bp, Artificial Sequence
  Synthetic: Hsa129F
accggcagcaggaagcgtggatgctggcctccctgtgagttccccgcgccagcggggataaaccgcaaagtcaaggagcatggaatcccggcccctc

SEQ ID NO: 626 - DNA, 97 bp, Artificial Sequence
  Synthetic: Hsa130F
accggtgcttgacatcattatgagctgagcattgctgagttccccgcgccagcggggataaaccggcttcctgtgtctaatgaccctgacaacccat

SEQ ID NO: 627 - DNA, 97 bp, Artificial Sequence
  Synthetic: Hsa131F
accggtaggccttgggtggccgatggcctcacagtggagttccccgcgccagcggggataaaccggagaagaagttcagttcagtgacaggtgagcc

SEQ ID NO: 628 - DNA, 97 bp, Artificial Sequence
  Synthetic: Hsa132F
accgacttgtctgtgttgcacagctaggtgaggcccgagttccccgcgccagcggggataaaccggcatcaccttaccatcagagcagtgcagtgct

SEQ ID NO: 629 - DNA, 97 bp, Artificial Sequence
  Synthetic: Hsa133F
accggagggctgagagagggacaagtcggaaccattgagttccccgcgccagcggggataaaccggggatgcttccgcctttccggggctgctggcc

SEQ ID NO: 630 - DNA, 97 bp, Artificial Sequence
  Synthetic: Hsa134F
accgagctgagcattgctgagctcggaaatcacctggagttccccgcgccagcggggataaaccggccagttttatgaatggcttcctgtgtctaat

SEQ ID NO: 631 - DNA, 97 bp, Artificial Sequence
  Synthetic: Hsa135F
accgtctacttccatagggaattgcaaccacagtatgagttccccgcgccagcggggataaaccggtcctgatcacttatgtaagtaactccattgt

SEQ ID NO: 632 - DNA, 97 bp, Artificial Sequence
  Synthetic: Hsa136F
accgtgacatgcccctggatgtcctcctccacacaggagttccccgcgccagcggggataaaccgcatgtacacccctaagatgcccatcgcgcagc

SEQ ID NO: 633 - DNA, 97 bp, Artificial Sequence
  Synthetic: Hsa137F
accggccatggaagacatgcaggatcttggtgaggtgagttccccgcgccagcggggataaaccgatgagtggcgacctgctggagctggtgagcca

SEQ ID NO: 634 - DNA, 97 bp, Artificial Sequence
  Synthetic: Hsa138F
accgaaggccatggaagacatgcaggatcttggtgagagttccccgcgccagcggggataaaccgagtggcgacctgctggagctggtgagccaccc

SEQ ID NO: 635 - DNA, 97 bp, Artificial Sequence
  Synthetic: Hsa139F
accgagggccatcagcacctttcacactcaccccccgagttccccgcgccagcggggataaaccgcccctgggggctccctgattaatggaggctta

SEQ ID NO: 636 - DNA, 97 bp, Artificial Sequence
  Synthetic: Hsa140F
accgctgaacagaaggtctcaggaagctccaggaaggagttccccgcgccagcggggataaaccgcatgcaagaaagatgactgtcccagcgagtgg

SEQ ID NO: 637 - DNA, 97 bp, Artificial Sequence
  Synthetic: Hsa141F
accgtggatcagtctctgcctcaactcggccagggtgagttccccgcgccagcggggataaaccgaggcctggttccctgaggaccagcgggtactg

SEQ ID NO: 638 - DNA, 97 bp, Artificial Sequence
  Synthetic: Hsa142F
accgcctggcacggaacaagagctcaataaaagtcagagttccccgcgccagcggggataaaccggaggcaggattcttcccatggataggggaggg

SEQ ID NO: 639 - DNA, 97 bp, Artificial Sequence
  Synthetic: Hsa143F
accgtgacatgcccctggatgtcctcctccacacaggagttccccgcgccagcggggataaaccgtacacccctaagatgcccatcgcgcagccctg

SEQ ID NO: 640 - DNA, 97 bp, Artificial Sequence
  Synthetic: Hsa144F
accgtttctctgagaattcagtgcatgcacatacaagagttccccgcgccagcggggataaaccggttcaaacaagctcaagagctagaagaaggag

SEQ ID NO: 641 - DNA, 97 bp, Artificial Sequence
  Synthetic: Hsa145F
accggagggctgagagagggacaagtcggaaccattgagttccccgcgccagcggggataaaccgcttccgcctttccggggctgctggcctggccc

SEQ ID NO: 642 - DNA, 97 bp, Artificial Sequence
  Synthetic: Hsa146F
accgtgtaccctgccgggtagtggagcgggttggctgagttccccgcgccagcggggataaaccgaaacctggaaccagagggggcgtgcctgccaa

SEQ ID NO: 643 - DNA, 97 bp, Artificial Sequence
  Synthetic: Hsa147F
accgattctgtatagcaacgcgtaccatctaagaccgagttccccgcgccagcggggataaaccgccaagtaagtgctgatttgttctcattcaact

SEQ ID NO: 644 - DNA, 97 bp, Artificial Sequence
  Synthetic: Hsa148F
accgctgaacagaaggtctcaggaagctccaggaaggagttccccgcgccagcggggataaaccgcaagaaagatgactgtcccagcgagtggcttc

SEQ ID NO: 645 - DNA, 97 bp, Artificial Sequence
  Synthetic: Hsa149F
accggaagacatgcaggatcttggtgaggtatccccgagttccccgcgccagcggggataaaccgatgagtggcgacctgctggagctggtgagcca

SEQ ID NO: 646 - DNA, 97 bp, Artificial Sequence
  Synthetic: Hsa150F
accggcagcaggaagcgtggatgctggcctccctgtgagttccccgcgccagcggggataaaccggagcatggaatcccggcccctcaggagcaggt

SEQ ID NO: 647 - DNA, 97 bp, Artificial Sequence
  Synthetic: Hsa151F
accgaactggactgtactgtcagcggagcccgagttgagttccccgcgccagcggggataaaccggagggagacggatttctttccttgctcagcaa

SEQ ID NO: 648 - DNA, 97 bp, Artificial Sequence
  Synthetic: Hsa152F
accggcaacttggcctcgactggaagtttctctgaggagttccccgcgccagcggggataaaccgaaggagctgctgtgtcagaggagccctcgtaa

SEQ ID NO: 649 - DNA, 97 bp, Artificial Sequence
  Synthetic: Hsa153F
accggctagcaccagctcctcgtagtcgccgtcctcgagttccccgcgccagcggggataaaccgcacccgagcacggaaccacagccaccttccac

SEQ ID NO: 650 - DNA, 97 bp, Artificial Sequence
  Synthetic: Hsa154F
accgctggcacccttggccacgccggcatcccggccgagttccccgcgccagcggggataaaccgggaagggcacggttagcggcaccctcataggt

SEQ ID NO: 651 - DNA, 97 bp, Artificial Sequence
  Synthetic: Hsa155F
accggggctgtcactggagctcctgggaggcctgcggagttccccgcgccagcggggataaaccgggctggggctgagctttaaaatggttccgact

SEQ ID NO: 652 - DNA, 97 bp, Artificial Sequence
  Synthetic: Hsa156F
accgggtggggggtaagctgaatggaatctctctcggagttccccgcgccagcggggataaaccgtgagaggggctgatggaagctgataggcagga

SEQ ID NO: 653 - DNA, 97 bp, Artificial Sequence
  Synthetic: Hsa157F
accgacatgcaggatcttggtgaggtatccccggcggagttccccgcgccagcggggataaaccgatgagtggcgacctgctggagctggtgagcca

SEQ ID NO: 654 - DNA, 97 bp, Artificial Sequence
  Synthetic: Hsa158F
accgtttgtccctgcagcccctaccgccccctccccgagttccccgcgccagcggggataaaccggccctcatctccagctaactgtggagaagccc

SEQ ID NO: 655 - DNA, 97 bp, Artificial Sequence
  Synthetic: Hsa159F
accgagctgagcattgctgagctcggaaatcacctggagttccccgcgccagcggggataaaccgaatggcttcctgtgtctaatgaccctgacaac

SEQ ID NO: 656 - DNA, 97 bp, Artificial Sequence
  Synthetic: Hsa160F
accgactgtttcattcatctctctggaaagcaggtggagttccccgcgccagcggggataaaccgcccagcacggtgcaagcttgtaaccgctttaa

SEQ ID NO: 657 - DNA, 97 bp, Artificial Sequence
  Synthetic: Hsa161F
accgcgtggatgctggcctccctgtggcccacgcacgagttccccgcgccagcggggataaaccgtcaaggagcatggaatcccggcccctcaggag

SEQ ID NO: 658 - DNA, 97 bp, Artificial Sequence
  Synthetic: Hsa162F
accgctgaacagaaggtctcaggaagctccaggaaggagttccccgcgccagcggggataaaccgatgactgtcccagcgagtggcttctctcagac

SEQ ID NO: 659 - DNA, 97 bp, Artificial Sequence
  Synthetic: Hsa163F
accggcagctgaattccccttgagacccaccgctaagagttccccgcgccagcggggataaaccggcatctttagtgatccaaggtaagaaaccctg

SEQ ID NO: 660 - DNA, 97 bp, Artificial Sequence
  Synthetic: Hsa164F
accgggtgtgtgtggagtggggagggggaaataaatgagttccccgcgccagcggggataaaccggacgtccgcgtgttttctctttcagttagctg

SEQ ID NO: 661 - DNA, 97 bp, Artificial Sequence
  Synthetic: Hsa165F
accgagctgagcattgctgagctcggaaatcacctggagttccccgcgccagcggggataaaccggcttcctgtgtctaatgaccctgacaacccat

SEQ ID NO: 662 - DNA, 97 bp, Artificial Sequence
  Synthetic: Hsa166F
accgtgacatgcccctggatgtcctcctccacacaggagttccccgcgccagcggggataaaccgatgcccatcgcgcagccctgcaacatttttga

SEQ ID NO: 663 - DNA, 97 bp, Artificial Sequence
  Synthetic: Hsa167F
accgaagaggttgctacaacctgacagcctgacagagagttccccgcgccagcggggataaaccgggtttatgcgtgtccacagtacaccctccctc

SEQ ID NO: 664 - DNA, 97 bp, Artificial Sequence
  Synthetic: Hsa168F
accggtagcccggggtgagtggcatttcatgagggggagttccccgcgccagcggggataaaccgtaaaatttgagaggaagacaatattaatctgt

SEQ ID NO: 665 - DNA, 97 bp, Artificial Sequence
  Synthetic: Hsa169F
accgttcaggagcagggcgcgtgaaggggcgcgcgggagttccccgcgccagcggggataaaccggcgccgccggcgtggaccgcgcacggcctcta

SEQ ID NO: 666 - DNA, 97 bp, Artificial Sequence
  Synthetic: Hsa170F
accgctggtgtctaggagatacacctccaccaggctgagttccccgcgccagcggggataaaccggtcaccgacttcgagaatgtgcccgaggagga

SEQ ID NO: 667 - DNA, 97 bp, Artificial Sequence
  Synthetic: Hsa171F
accgactgtcacacttgctggcctgctcgacgaacagagttccccgcgccagcggggataaaccgccggcgtggccaagggtgccagcatgcgcagc

SEQ ID NO: 668 - DNA, 97 bp, Artificial Sequence
  Synthetic: Hsa172F
accggctccccgcaggccacctttgggtgttgctaggagttccccgcgccagcggggataaaccgcactgtctcagccaacccgctccactacccgg

SEQ ID NO: 669 - DNA, 97 bp, Artificial Sequence
  Synthetic: Hsa173F
accgcaggatcttggtgaggtatccccggcgggcaggagttccccgcgccagcggggataaaccgagtggcgacctgctggagctggtgagccaccc

SEQ ID NO: 670 - DNA, 97 bp, Artificial Sequence
  Synthetic: Hsa174F
accgctcagccccagcccttgaccctccccagacacgagttccccgcgccagcggggataaaccggcctggcacgaggggatggggatgcttccgcc

SEQ ID NO: 671 - DNA, 97 bp, Artificial Sequence
  Synthetic: Hsa175F
accgagctcaataaaagtcattctgcccacggacatgagttccccgcgccagcggggataaaccggaggcaggattcttcccatggataggggaggg

SEQ ID NO: 672 - DNA, 97 bp, Artificial Sequence
  Synthetic: Hsa176F
accgccattcataaaactggccatggtgcttgacatgagttccccgcgccagcggggataaaccgtgccaagccaaaggaacaaccctggttgttga

SEQ ID NO: 673 - DNA, 97 bp, Artificial Sequence
  Synthetic: Hsa177F
accgctggcctccctgtggcccacgcactggttggggagttccccgcgccagcggggataaaccgtcaaggagcatggaatcccggcccctcaggag

SEQ ID NO: 674 - DNA, 97 bp, Artificial Sequence
  Synthetic: Hsa178F
accgctgctaagtgctcctctgcctgctgtcacatcgagttccccgcgccagcggggataaaccggaatgctgccgtcgggcaactcctggcacact

SEQ ID NO: 675 - DNA, 97 bp, Artificial Sequence
  Synthetic: Hsa179F
accgatctgtaaggaatcatctggctgtagaagaatgagttccccgcgccagcggggataaaccgccaccaatgccttgggatacgactctgtctcc

SEQ ID NO: 676 - DNA, 97 bp, Artificial Sequence
  Synthetic: Hsa180F
accgcagcctggaagcccctgctcaccctgccccacgagttccccgcgccagcggggataaaccgctcagagccctgctgcccacaacagagcactg

SEQ ID NO: 677 - DNA, 97 bp, Artificial Sequence
  Synthetic: Hsa181F
accgcctggcacggaacaagagctcaataaaagtcagagttccccgcgccagcggggataaaccggataggggagggggcggtaggggctgcaggga

SEQ ID NO: 678 - DNA, 97 bp, Artificial Sequence
  Synthetic: Hsa182F
accggaaagttcctgtggagctgagactgttttcacgagttccccgcgccagcggggataaaccgagatactgagaatggctggaccactcacagca

SEQ ID NO: 679 - DNA, 97 bp, Artificial Sequence
  Synthetic: Hsa183F
accgctccaggaagctgccatcagccatgcgctgctgagttccccgcgccagcggggataaaccgcatgcaagaaagatgactgtcccagcgagtgg

SEQ ID NO: 680 - DNA, 97 bp, Artificial Sequence
  Synthetic: Hsa184F
accgaggtgctggccgtccttctcccaggtgatgaggagttccccgcgccagcggggataaaccgatccaccgcctcaagccctcggatgcaggcgt

SEQ ID NO: 681 - DNA, 97 bp, Artificial Sequence
  Synthetic: Hsa185F
accgcgtggatgctggcctccctgtggcccacgcacgagttccccgcgccagcggggataaaccggaatcccggcccctcaggagcaggtgaagagg

SEQ ID NO: 682 - DNA, 97 bp, Artificial Sequence
  Synthetic: Hsa186F
accgagggccatcagcacctttcacactcaccccccgagttccccgcgccagcggggataaaccggaggcttagctttctggatggcatctagccag

SEQ ID NO: 683 - DNA, 97 bp, Artificial Sequence
  Synthetic: Hsa187F
accgtgctcctctgcctgctgtcacatccagtactggagttccccgcgccagcggggataaaccgcatggaatgctgccgtcgggcaactcctggca

SEQ ID NO: 684 - DNA, 97 bp, Artificial Sequence
  Synthetic: Hsa188F
accgcccctggatgtcctcctccacacaggaaactggagttccccgcgccagcggggataaaccgcccatcgcgcagccctgcaacatttttgactg

SEQ ID NO: 685 - DNA, 97 bp, Artificial Sequence
  Synthetic: Hsa189F
accgctctgggcaaagacagaggagtcctcctcgatgagttccccgcgccagcggggataaaccgaataccagccccccggtaagacccccatctgt

SEQ ID NO: 686 - DNA, 97 bp, Artificial Sequence
  Synthetic: Hsa190F
accgaggagcccagccgggtgaagtaagaagaggctgagttccccgcgccagcggggataaaccgctcggtgagtgatggcagaacgatgcctgcag

SEQ ID NO: 687 - DNA, 97 bp, Artificial Sequence
  Synthetic: Hsa191F
accgccccccccacacgaggaggagcacgcggtccagagttccccgcgccagcggggataaaccgtcacttcagtggaagagtggaaatgcatgtac

SEQ ID NO: 688 - DNA, 97 bp, Artificial Sequence
  Synthetic: Hsa192F
accgactgtttcattcatctctctggaaagcaggtggagttccccgcgccagcggggataaaccgcttgtaaccgctttaattgccccccagcctgg

SEQ ID NO: 689 - DNA, 97 bp, Artificial Sequence
  Synthetic: Hsa193F
accggaatctctctcggagcaggcagccagccaatcgagttccccgcgccagcggggataaaccgtgagaggggctgatggaagctgataggcagga

SEQ ID NO: 690 - DNA, 97 bp, Artificial Sequence
  Synthetic: Hsa194F
accgtgctcctctgcctgctgtcacatccagtactggagttccccgcgccagcggggataaaccggaatgctgccgtcgggcaactcctggcacact

SEQ ID NO: 691 - DNA, 97 bp, Artificial Sequence
  Synthetic: Hsa195F
accgtttctctgagaattcagtgcatgcacatacaagagttccccgcgccagcggggataaaccgaaggagctgctgtgtcagaggagccctcgtaa

SEQ ID NO: 692 - DNA, 97 bp, Artificial Sequence
  Synthetic: Hsa196F
accgaatcctggagcgacagaaaagaaatatagaccgagttccccgcgccagcggggataaaccgtgggtttctacacttgcaatgccaccaatgcc

SEQ ID NO: 693 - DNA, 97 bp, Artificial Sequence
  Synthetic: Hsa197F
accgactgtcacacttgctggcctgctcgacgaacagagttccccgcgccagcggggataaaccgggtgccagcatgcgcagcctgcgcgtgctcaa

SEQ ID NO: 694 - DNA, 97 bp, Artificial Sequence
  Synthetic: Hsa198F
accgcctgcaggcatcgttctgccatcactcaccgagagttccccgcgccagcggggataaaccgcttctaaggcatggtcgggggagagggccaac

SEQ ID NO: 695 - DNA, 97 bp, Artificial Sequence
  Synthetic: Hsa199F
accgcaaaacaggtctagaaaagttggctgtaaaaagagttccccgcgccagcggggataaaccggtgactttttaaaataaaaacaaacaaacgtt

SEQ ID NO: 696 - DNA, 97 bp, Artificial Sequence
  Synthetic: Hsa200F
accgctccaggaagctgccatcagccatgcgctgctgagttccccgcgccagcggggataaaccgaaagatgactgtcccagcgagtggcttctctc

SEQ ID NO: 697 - DNA, 97 bp, Artificial Sequence
  Synthetic: Hsa201F
accgctggcctccctgtggcccacgcactggttggggagttccccgcgccagcggggataaaccggaatcccggcccctcaggagcaggtgaagagg

SEQ ID NO: 698 - DNA, 97 bp, Artificial Sequence
  Synthetic: Hsa202F
accgtcactgtgcactggaaagagattgcaagagaggagttccccgcgccagcggggataaaccgcacacaggaggctgtagcccaaaaacaaagcc

SEQ ID NO: 699 - DNA, 97 bp, Artificial Sequence
  Synthetic: Hsa203F
accgacgtctctggtctgtaggccgaccccacatgtgagttccccgcgccagcggggataaaccgagctgtgtcgccagcccaagcccagcacggtg

SEQ ID NO: 700 - DNA, 97 bp, Artificial Sequence
  Synthetic: Hsa204F
accgctgccatcagccatgcgctgcttgcaaagaacgagttccccgcgccagcggggataaaccgcatgcaagaaagatgactgtcccagcgagtgg

SEQ ID NO: 701 - DNA, 97 bp, Artificial Sequence
  Synthetic: Hsa205F
accgaggcttggcttcagagccagcccaatctgcgtgagttccccgcgccagcggggataaaccggggaacacagaccaggaagctcggtgagtgat

SEQ ID NO: 702 - DNA, 97 bp, Artificial Sequence
  Synthetic: Hsa206F
accgtcctcctccacacaggaaactgcccggctctggagttccccgcgccagcggggataaaccgcccatcgcgcagccctgcaacatttttgactg

SEQ ID NO: 703 - DNA, 97 bp, Artificial Sequence
  Synthetic: Hsa207F
accgctccaggaagctgccatcagccatgcgctgctgagttccccgcgccagcggggataaaccgatgactgtcccagcgagtggcttctctcagac

SEQ ID NO: 704 - DNA, 97 bp, Artificial Sequence
  Synthetic: Hsa208F
accgaacactcagtgtcccgctggccagggccaccggagttccccgcgccagcggggataaaccggagaagaagttcagttcagtgacaggtgagcc

SEQ ID NO: 705 - DNA, 97 bp, Artificial Sequence
  Synthetic: Hsa209F
accgctcagccccagcccttgaccctccccagacacgagttccccgcgccagcggggataaaccggggatgcttccgcctttccggggctgctggcc

SEQ ID NO: 706 - DNA, 97 bp, Artificial Sequence
  Synthetic: Hsa210F
accgttccatgcctgcaggcatcgttctgccatcacgagttccccgcgccagcggggataaaccggtcgggggagagggccaacaactgtccctcct

SEQ ID NO: 707 - DNA, 97 bp, Artificial Sequence
  Synthetic: Hsa211F
accgctgaatggaatctctctcggagcaggcagccagagttccccgcgccagcggggataaaccggaagctgataggcaggactggagtgttagcac

SEQ ID NO: 708 - DNA, 97 bp, Artificial Sequence
  Synthetic: Hsa212F
accggaaagttcctgtggagctgagactgttttcacgagttccccgcgccagcggggataaaccggctggaccactcacagcagatttcattgtcaa

SEQ ID NO: 709 - DNA, 97 bp, Artificial Sequence
  Synthetic: Hsa213F
accggggcgcgcggaatcctggctgggagctgggaggagttccccgcgccagcggggataaaccggcgccgccggcgtggaccgcgcacggcctcta

SEQ ID NO: 710 - DNA, 97 bp, Artificial Sequence
  Synthetic: Hsa214F
accgacagaggagtcctcctcgatgtagtcgacatggagttccccgcgccagcggggataaaccgaataccagccccccggtaagacccccatctgt

SEQ ID NO: 711 - DNA, 97 bp, Artificial Sequence
  Synthetic: Hsa215F
accgagctcaataaaagtcattctgcccacggacatgagttccccgcgccagcggggataaaccggataggggagggggcggtaggggctgcaggga

SEQ ID NO: 712 - DNA, 97 bp, Artificial Sequence
  Synthetic: Hsa216F
accgcctgcaggcatcgttctgccatcactcaccgagagttccccgcgccagcggggataaaccggcatggtcgggggagagggccaacaactgtcc

SEQ ID NO: 713 - DNA, 97 bp, Artificial Sequence
  Synthetic: Hsa217F
accgaggagcccagccgggtgaagtaagaagaggctgagttccccgcgccagcggggataaaccggcagaacgatgcctgcaggcatggaacttttt

SEQ ID NO: 714 - DNA, 97 bp, Artificial Sequence
  Synthetic: Hsa218F
accgctgaatggaatctctctcggagcaggcagccagagttccccgcgccagcggggataaaccgctgataggcaggactggagtgttagcaccagt

SEQ ID NO: 715 - DNA, 97 bp, Artificial Sequence
  Synthetic: Hsa219F
accgctgccatcagccatgcgctgcttgcaaagaacgagttccccgcgccagcggggataaaccgaaagatgactgtcccagcgagtggcttctctc

SEQ ID NO: 716 - DNA, 97 bp, Artificial Sequence
  Synthetic: Hsa220F
accgccccccaccacgaagtgcagcttcctctgcctgagttccccgcgccagcggggataaaccgcccctcatcacctgggagaaggacggccagca

SEQ ID NO: 717 - DNA, 97 bp, Artificial Sequence
  Synthetic: Hsa221F
accgactgtcacacttgctggcctgctcgacgaacagagttccccgcgccagcggggataaaccgcgcagcctgcgcgtgctcaactgccaagggaa

SEQ ID NO: 718 - DNA, 97 bp, Artificial Sequence
  Synthetic: Hsa222F
accgctcagccccagcccttgaccctccccagacacgagttccccgcgccagcggggataaaccgcttccgcctttccggggctgctggcctggccc

SEQ ID NO: 719 - DNA, 97 bp, Artificial Sequence
  Synthetic: Hsa223F
accgcatctccgccaggccagtgaatcaggcctggggagttccccgcgccagcggggataaaccgcaagcagacatttatcttttgggtctgtcctc

SEQ ID NO: 720 - DNA, 97 bp, Artificial Sequence
  Synthetic: Hsa224F
accggacgaaaaagaaaggcgagcgagcagcagagcgagttccccgcgccagcggggataaaccgtctgattagcaggagcctgattggctggctgc

SEQ ID NO: 721 - DNA, 97 bp, Artificial Sequence
  Synthetic: Hsa129R
actcgaggggccgggattccatgctccttgactttgcggtttatccccgctggcgcggggaactcacagggaggccagcatccacgcttcctgctgc

SEQ ID NO: 722 - DNA, 97 bp, Artificial Sequence
  Synthetic: Hsa130R
actcatgggttgtcagggtcattagacacaggaagccggtttatccccgctggcgcggggaactcagcaatgctcagctcataatgatgtcaagcac

SEQ ID NO: 723 - DNA, 97 bp, Artificial Sequence
  Synthetic: Hsa131R
actcggctcacctgtcactgaactgaacttcttctccggtttatccccgctggcgcggggaactccactgtgaggccatcggccacccaaggcctac

SEQ ID NO: 724 - DNA, 97 bp, Artificial Sequence
  Synthetic: Hsa132R
actcagcactgcactgctctgatggtaaggtgatgccggtttatccccgctggcgcggggaactcgggcctcacctagctgtgcaacacagacaagt

SEQ ID NO: 725 - DNA, 97 bp, Artificial Sequence
  Synthetic: Hsa133R
actcggccagcagccccggaaaggcggaagcatccccggtttatccccgctggcgcggggaactcaatggttccgacttgtccctctctcagccctc

SEQ ID NO: 726 - DNA, 97 bp, Artificial Sequence
  Synthetic: Hsa134R
actcattagacacaggaagccattcataaaactggccggtttatccccgctggcgcggggaactccaggtgatttccgagctcagcaatgctcagct

SEQ ID NO: 727 - DNA, 97 bp, Artificial Sequence
  Synthetic: Hsa135R
actcacaatggagttacttacataagtgatcaggaccggtttatccccgctggcgcggggaactcatactgtggttgcaattccctatggaagtaga

SEQ ID NO: 728 - DNA, 97 bp, Artificial Sequence
  Synthetic: Hsa136R
actcgctgcgcgatgggcatcttaggggtgtacatgcggtttatccccgctggcgcggggaactcctgtgtggaggaggacatccaggggcatgtca

SEQ ID NO: 729 - DNA, 97 bp, Artificial Sequence
  Synthetic: Hsa137R
actctggctcaccagctccagcaggtcgccactcatcggtttatccccgctggcgcggggaactcacctcaccaagatcctgcatgtcttccatggc

SEQ ID NO: 730 - DNA, 97 bp, Artificial Sequence
  Synthetic: Hsa138R
actcgggtggctcaccagctccagcaggtcgccactcggtttatccccgctggcgcggggaactctcaccaagatcctgcatgtcttccatggcctt

SEQ ID NO: 731 - DNA, 97 bp, Artificial Sequence
  Synthetic: Hsa139R
actctaagcctccattaatcagggagcccccaggggcggtttatccccgctggcgcggggaactcggggggtgagtgtgaaaggtgctgatggccct

SEQ ID NO: 732 - DNA, 97 bp, Artificial Sequence
  Synthetic: Hsa140R
actcccactcgctgggacagtcatctttcttgcatgcggtttatccccgctggcgcggggaactccttcctggagcttcctgagaccttctgttcag

SEQ ID NO: 733 - DNA, 97 bp, Artificial Sequence
  Synthetic: Hsa141R
actccagtacccgctggtcctcagggaaccaggcctcggtttatccccgctggcgcggggaactcaccctggccgagttgaggcagagactgatcca

SEQ ID NO: 734 - DNA, 97 bp, Artificial Sequence
  Synthetic: Hsa142R
actcccctcccctatccatgggaagaatcctgcctccggtttatccccgctggcgcggggaactctgacttttattgagctcttgttccgtgccagg

SEQ ID NO: 735 - DNA, 97 bp, Artificial Sequence
  Synthetic: Hsa143R
actccagggctgcgcgatgggcatcttaggggtgtacggtttatccccgctggcgcggggaactcctgtgtggaggaggacatccaggggcatgtca

SEQ ID NO: 736 - DNA, 97 bp, Artificial Sequence
  Synthetic: Hsa144R
actcctccttcttctagctcttgagcttgtttgaaccggtttatccccgctggcgcggggaactcttgtatgtgcatgcactgaattctcagagaaa

SEQ ID NO: 737 - DNA, 97 bp, Artificial Sequence
  Synthetic: Hsa145R
actcgggccaggccagcagccccggaaaggcggaagcggtttatccccgctggcgcggggaactcaatggttccgacttgtccctctctcagccctc

SEQ ID NO: 738 - DNA, 97 bp, Artificial Sequence
  Synthetic: Hsa146R
actcttggcaggcacgccccctctggttccaggtttcggtttatccccgctggcgcggggaactcagccaacccgctccactacccggcagggtaca

SEQ ID NO: 739 - DNA, 97 bp, Artificial Sequence
  Synthetic: Hsa147R
actcagttgaatgagaacaaatcagcacttacttggcggtttatccccgctggcgcggggaactcggtcttagatggtacgcgttgctatacagaat

SEQ ID NO: 740 - DNA, 97 bp, Artificial Sequence
  Synthetic: Hsa148R
actcgaagccactcgctgggacagtcatctttcttgcggtttatccccgctggcgcggggaactccttcctggagcttcctgagaccttctgttcag

SEQ ID NO: 741 - DNA, 97 bp, Artificial Sequence
  Synthetic: Hsa149R
actctggctcaccagctccagcaggtcgccactcatcggtttatccccgctggcgcggggaactcggggatacctcaccaagatcctgcatgtcttc

SEQ ID NO: 742 - DNA, 97 bp, Artificial Sequence
  Synthetic: Hsa150R
actcacctgctcctgaggggccgggattccatgctccggtttatccccgctggcgcggggaactcacagggaggccagcatccacgcttcctgctgc

SEQ ID NO: 743 - DNA, 97 bp, Artificial Sequence
  Synthetic: Hsa151R
actcttgctgagcaaggaaagaaatccgtctccctccggtttatccccgctggcgcggggaactcaactcgggctccgctgacagtacagtccagtt

SEQ ID NO: 744 - DNA, 97 bp, Artificial Sequence
  Synthetic: Hsa152R
actcttacgagggctcctctgacacagcagctccttcggtttatccccgctggcgcggggaactcctcagagaaacttccagtcgaggccaagttgc

SEQ ID NO: 745 - DNA, 97 bp, Artificial Sequence
  Synthetic: Hsa153R
actcgtggaaggtggctgtggttccgtgctcgggtgcggtttatccccgctggcgcggggaactcgaggacggcgactacgaggagctggtgctagc

SEQ ID NO: 746 - DNA, 97 bp, Artificial Sequence
  Synthetic: Hsa154R
actcacctatgagggtgccgctaaccgtgcccttcccggtttatccccgctggcgcggggaactcggccgggatgccggcgtggccaagggtgccag

SEQ ID NO: 747 - DNA, 97 bp, Artificial Sequence
  Synthetic: Hsa155R
actcagtcggaaccattttaaagctcagccccagcccggtttatccccgctggcgcggggaactccgcaggcctcccaggagctccagtgacagccc

SEQ ID NO: 748 - DNA, 97 bp, Artificial Sequence
  Synthetic: Hsa156R
actctcctgcctatcagcttccatcagcccctctcacggtttatccccgctggcgcggggaactccgagagagattccattcagcttaccccccacc

SEQ ID NO: 749 - DNA, 97 bp, Artificial Sequence
  Synthetic: Hsa157R
actctggctcaccagctccagcaggtcgccactcatcggtttatccccgctggcgcggggaactccgccggggatacctcaccaagatcctgcatgt

SEQ ID NO: 750 - DNA, 97 bp, Artificial Sequence
  Synthetic: Hsa158R
actcgggcttctccacagttagctggagatgagggccggtttatccccgctggcgcggggaactcggggagggggcggtaggggctgcagggacaaa

SEQ ID NO: 751 - DNA, 97 bp, Artificial Sequence
  Synthetic: Hsa159R
actcgttgtcagggtcattagacacaggaagccattcggtttatccccgctggcgcggggaactccaggtgatttccgagctcagcaatgctcagct

SEQ ID NO: 752 - DNA, 97 bp, Artificial Sequence
  Synthetic: Hsa160R
actcttaaagcggttacaagcttgcaccgtgctgggcggtttatccccgctggcgcggggaactccacctgctttccagagagatgaatgaaacagt

SEQ ID NO: 753 - DNA, 97 bp, Artificial Sequence
  Synthetic: Hsa161R
actcctcctgaggggccgggattccatgctccttgacggtttatccccgctggcgcggggaactcgtgcgtgggccacagggaggccagcatccacg

SEQ ID NO: 754 - DNA, 97 bp, Artificial Sequence
  Synthetic: Hsa162R
actcgtctgagagaagccactcgctgggacagtcatcggtttatccccgctggcgcggggaactccttcctggagcttcctgagaccttctgttcag

SEQ ID NO: 755 - DNA, 97 bp, Artificial Sequence
  Synthetic: Hsa163R
actccagggtttcttaccttggatcactaaagatgccggtttatccccgctggcgcggggaactcttagcggtgggtctcaaggggaattcagctgc

SEQ ID NO: 756 - DNA, 97 bp, Artificial Sequence
  Synthetic: Hsa164R
actccagctaactgaaagagaaaacacgcggacgtccggtttatccccgctggcgcggggaactcatttatttccccctccccactccacacacacc

SEQ ID NO: 757 - DNA, 97 bp, Artificial Sequence
  Synthetic: Hsa165R
actcatgggttgtcagggtcattagacacaggaagccggtttatccccgctggcgcggggaactccaggtgatttccgagctcagcaatgctcagct

SEQ ID NO: 758 - DNA, 97 bp, Artificial Sequence
  Synthetic: Hsa166R
actctcaaaaatgttgcagggctgcgcgatgggcatcggtttatccccgctggcgcggggaactcctgtgtggaggaggacatccaggggcatgtca

SEQ ID NO: 759 - DNA, 97 bp, Artificial Sequence
  Synthetic: Hsa167R
actcgagggagggtgtactgtggacacgcataaacccggtttatccccgctggcgcggggaactctctgtcaggctgtcaggttgtagcaacctctt

SEQ ID NO: 760 - DNA, 97 bp, Artificial Sequence
  Synthetic: Hsa168R
actcacagattaatattgtcttcctctcaaattttacggtttatccccgctggcgcggggaactccccctcatgaaatgccactcaccccgggctac

SEQ ID NO: 761 - DNA, 97 bp, Artificial Sequence
  Synthetic: Hsa169R
actctagaggccgtgcgcggtccacgccggcggcgccggtttatccccgctggcgcggggaactcccgcgcgccccttcacgcgccctgctcctgaa

SEQ ID NO: 762 - DNA, 97 bp, Artificial Sequence
  Synthetic: Hsa170R
actctcctcctcgggcacattctcgaagtcggtgaccggtttatccccgctggcgcggggaactcagcctggtggaggtgtatctcctagacaccag

SEQ ID NO: 763 - DNA, 97 bp, Artificial Sequence
  Synthetic: Hsa171R
actcgctgcgcatgctggcacccttggccacgccggcggtttatccccgctggcgcggggaactctgttcgtcgagcaggccagcaagtgtgacagt

SEQ ID NO: 764 - DNA, 97 bp, Artificial Sequence
  Synthetic: Hsa172R
actcccgggtagtggagcgggttggctgagacagtgcggtttatccccgctggcgcggggaactcctagcaacacccaaaggtggcctgcggggagc

SEQ ID NO: 765 - DNA, 97 bp, Artificial Sequence
  Synthetic: Hsa173R
actcgggtggctcaccagctccagcaggtcgccactcggtttatccccgctggcgcggggaactcctgcccgccggggatacctcaccaagatcctg

SEQ ID NO: 766 - DNA, 97 bp, Artificial Sequence
  Synthetic: Hsa174R
actcggcggaagcatccccatcccctcgtgccaggccggtttatccccgctggcgcggggaactcgtgtctggggagggtcaagggctggggctgag

SEQ ID NO: 767 - DNA, 97 bp, Artificial Sequence
  Synthetic: Hsa175R
actcccctcccctatccatgggaagaatcctgcctccggtttatccccgctggcgcggggaactcatgtccgtgggcagaatgacttttattgagct

SEQ ID NO: 768 - DNA, 97 bp, Artificial Sequence
  Synthetic: Hsa176R
actctcaacaaccagggttgttcctttggcttggcacggtttatccccgctggcgcggggaactcatgtcaagcaccatggccagttttatgaatgg

SEQ ID NO: 769 - DNA, 97 bp, Artificial Sequence
  Synthetic: Hsa177R
actcctcctgaggggccgggattccatgctccttgacggtttatccccgctggcgcggggaactccccaaccagtgcgtgggccacagggaggccag

SEQ ID NO: 770 - DNA, 97 bp, Artificial Sequence
  Synthetic: Hsa178R
actcagtgtgccaggagttgcccgacggcagcattccggtttatccccgctggcgcggggaactcgatgtgacagcaggcagaggagcacttagcag

SEQ ID NO: 771 - DNA, 97 bp, Artificial Sequence
  Synthetic: Hsa179R
actcggagacagagtcgtatcccaaggcattggtggcggtttatccccgctggcgcggggaactcattcttctacagccagatgattccttacagat

SEQ ID NO: 772 - DNA, 97 bp, Artificial Sequence
  Synthetic: Hsa180R
actccagtgctctgttgtgggcagcagggctctgagcggtttatccccgctggcgcggggaactcgtggggcagggtgagcaggggcttccaggctg

SEQ ID NO: 773 - DNA, 97 bp, Artificial Sequence
  Synthetic: Hsa181R
actctccctgcagcccctaccgccccctcccctatccggtttatccccgctggcgcggggaactctgacttttattgagctcttgttccgtgccagg

SEQ ID NO: 774 - DNA, 97 bp, Artificial Sequence
  Synthetic: Hsa182R
actctgctgtgagtggtccagccattctcagtatctcggtttatccccgctggcgcggggaactcgtgaaaacagtctcagctccacaggaactttc

SEQ ID NO: 775 - DNA, 97 bp, Artificial Sequence
  Synthetic: Hsa183R
actcccactcgctgggacagtcatctttcttgcatgcggtttatccccgctggcgcggggaactcagcagcgcatggctgatggcagcttcctggag

SEQ ID NO: 776 - DNA, 97 bp, Artificial Sequence
  Synthetic: Hsa184R
actcacgcctgcatccgagggcttgaggcggtggatcggtttatccccgctggcgcggggaactcctcatcacctgggagaaggacggccagcacct

SEQ ID NO: 777 - DNA, 97 bp, Artificial Sequence
  Synthetic: Hsa185R
actccctcttcacctgctcctgaggggccgggattccggtttatccccgctggcgcggggaactcgtgcgtgggccacagggaggccagcatccacg

SEQ ID NO: 778 - DNA, 97 bp, Artificial Sequence
  Synthetic: Hsa186R
actcctggctagatgccatccagaaagctaagcctccggtttatccccgctggcgcggggaactcggggggtgagtgtgaaaggtgctgatggccct

SEQ ID NO: 779 - DNA, 97 bp, Artificial Sequence
  Synthetic: Hsa187R
actctgccaggagttgcccgacggcagcattccatgcggtttatccccgctggcgcggggaactccagtactggatgtgacagcaggcagaggagca

SEQ ID NO: 780 - DNA, 97 bp, Artificial Sequence
  Synthetic: Hsa188R
actccagtcaaaaatgttgcagggctgcgcgatgggcggtttatccccgctggcgcggggaactccagtttcctgtgtggaggaggacatccagggg

SEQ ID NO: 781 - DNA, 97 bp, Artificial Sequence
  Synthetic: Hsa189R
actcacagatgggggtcttaccggggggctggtattcggtttatccccgctggcgcggggaactcatcgaggaggactcctctgtctttgcccagag

SEQ ID NO: 782 - DNA, 97 bp, Artificial Sequence
  Synthetic: Hsa190R
actcctgcaggcatcgttctgccatcactcaccgagcggtttatccccgctggcgcggggaactcagcctcttcttacttcacccggctgggctcct

SEQ ID NO: 783 - DNA, 97 bp, Artificial Sequence
  Synthetic: Hsa191R
actcgtacatgcatttccactcttccactgaagtgacggtttatccccgctggcgcggggaactctggaccgcgtgctcctcctcgtgtgggggggg

SEQ ID NO: 784 - DNA, 97 bp, Artificial Sequence
  Synthetic: Hsa192R
actcccaggctggggggcaattaaagcggttacaagcggtttatccccgctggcgcggggaactccacctgctttccagagagatgaatgaaacagt

SEQ ID NO: 785 - DNA, 97 bp, Artificial Sequence
  Synthetic: Hsa193R
actctcctgcctatcagcttccatcagcccctctcacggtttatccccgctggcgcggggaactcgattggctggctgcctgctccgagagagattc

SEQ ID NO: 786 - DNA, 97 bp, Artificial Sequence
  Synthetic: Hsa194R
actcagtgtgccaggagttgcccgacggcagcattccggtttatccccgctggcgcggggaactccagtactggatgtgacagcaggcagaggagca

SEQ ID NO: 787 - DNA, 97 bp, Artificial Sequence
  Synthetic: Hsa195R
actcttacgagggctcctctgacacagcagctccttcggtttatccccgctggcgcggggaactcttgtatgtgcatgcactgaattctcagagaaa

SEQ ID NO: 788 - DNA, 97 bp, Artificial Sequence
  Synthetic: Hsa196R
actcggcattggtggcattgcaagtgtagaaacccacggtttatccccgctggcgcggggaactcggtctatatttcttttctgtcgctccaggatt

SEQ ID NO: 789 - DNA, 97 bp, Artificial Sequence
  Synthetic: Hsa197R
actcttgagcacgcgcaggctgcgcatgctggcacccggtttatccccgctggcgcggggaactctgttcgtcgagcaggccagcaagtgtgacagt

SEQ ID NO: 790 - DNA, 97 bp, Artificial Sequence
  Synthetic: Hsa198R
actcgttggccctctcccccgaccatgccttagaagcggtttatccccgctggcgcggggaactctcggtgagtgatggcagaacgatgcctgcagg

SEQ ID NO: 791 - DNA, 97 bp, Artificial Sequence
  Synthetic: Hsa199R
actcaacgtttgtttgtttttattttaaaaagtcaccggtttatccccgctggcgcggggaactctttttacagccaacttttctagacctgttttg

SEQ ID NO: 792 - DNA, 97 bp, Artificial Sequence
  Synthetic: Hsa200R
actcgagagaagccactcgctgggacagtcatctttcggtttatccccgctggcgcggggaactcagcagcgcatggctgatggcagcttcctggag

SEQ ID NO: 793 - DNA, 97 bp, Artificial Sequence
  Synthetic: Hsa201R
actccctcttcacctgctcctgaggggccgggattccggtttatccccgctggcgcggggaactccccaaccagtgcgtgggccacagggaggccag

SEQ ID NO: 794 - DNA, 97 bp, Artificial Sequence
  Synthetic: Hsa202R
actcggctttgtttttgggctacagcctcctgtgtgcggtttatccccgctggcgcggggaactcctctcttgcaatctctttccagtgcacagtga

SEQ ID NO: 795 - DNA, 97 bp, Artificial Sequence
  Synthetic: Hsa203R
actccaccgtgctgggcttgggctggcgacacagctcggtttatccccgctggcgcggggaactcacatgtggggtcggcctacagaccagagacgt

SEQ ID NO: 796 - DNA, 97 bp, Artificial Sequence
  Synthetic: Hsa204R
actcccactcgctgggacagtcatctttcttgcatgcggtttatccccgctggcgcggggaactcgttctttgcaagcagcgcatggctgatggcag

SEQ ID NO: 797 - DNA, 97 bp, Artificial Sequence
  Synthetic: Hsa205R
actcatcactcaccgagcttcctggtctgtgttccccggtttatccccgctggcgcggggaactcacgcagattgggctggctctgaagccaagcct

SEQ ID NO: 798 - DNA, 97 bp, Artificial Sequence
  Synthetic: Hsa206R
actccagtcaaaaatgttgcagggctgcgcgatgggcggtttatccccgctggcgcggggaactccagagccgggcagtttcctgtgtggaggagga

SEQ ID NO: 799 - DNA, 97 bp, Artificial Sequence
  Synthetic: Hsa207R
actcgtctgagagaagccactcgctgggacagtcatcggtttatccccgctggcgcggggaactcagcagcgcatggctgatggcagcttcctggag

SEQ ID NO: 800 - DNA, 97 bp, Artificial Sequence
  Synthetic: Hsa208R
actcggctcacctgtcactgaactgaacttcttctccggtttatccccgctggcgcggggaactccggtggccctggccagcgggacactgagtgtt

SEQ ID NO: 801 - DNA, 97 bp, Artificial Sequence
  Synthetic: Hsa209R
actcggccagcagccccggaaaggcggaagcatccccggtttatccccgctggcgcggggaactcgtgtctggggagggtcaagggctggggctgag

SEQ ID NO: 802 - DNA, 97 bp, Artificial Sequence
  Synthetic: Hsa210R
actcaggagggacagttgttggccctctcccccgaccggtttatccccgctggcgcggggaactcgtgatggcagaacgatgcctgcaggcatggaa

SEQ ID NO: 803 - DNA, 97 bp, Artificial Sequence
  Synthetic: Hsa211R
actcgtgctaacactccagtcctgcctatcagcttccggtttatccccgctggcgcggggaactctggctgcctgctccgagagagattccattcag

SEQ ID NO: 804 - DNA, 97 bp, Artificial Sequence
  Synthetic: Hsa212R
actcttgacaatgaaatctgctgtgagtggtccagccggtttatccccgctggcgcggggaactcgtgaaaacagtctcagctccacaggaactttc

SEQ ID NO: 805 - DNA, 97 bp, Artificial Sequence
  Synthetic: Hsa213R
actctagaggccgtgcgcggtccacgccggcggcgccggtttatccccgctggcgcggggaactcctcccagctcccagccaggattccgcgcgccc

SEQ ID NO: 806 - DNA, 97 bp, Artificial Sequence
  Synthetic: Hsa214R
actcacagatgggggtcttaccggggggctggtattcggtttatccccgctggcgcggggaactccatgtcgactacatcgaggaggactcctctgt

SEQ ID NO: 807 - DNA, 97 bp, Artificial Sequence
  Synthetic: Hsa215R
actctccctgcagcccctaccgccccctcccctatccggtttatccccgctggcgcggggaactcatgtccgtgggcagaatgacttttattgagct

SEQ ID NO: 808 - DNA, 97 bp, Artificial Sequence
  Synthetic: Hsa216R
actcggacagttgttggccctctcccccgaccatgccggtttatccccgctggcgcggggaactctcggtgagtgatggcagaacgatgcctgcagg

SEQ ID NO: 809 - DNA, 97 bp, Artificial Sequence
  Synthetic: Hsa217R
actcaaaaagttccatgcctgcaggcatcgttctgccggtttatccccgctggcgcggggaactcagcctcttcttacttcacccggctgggctcct

SEQ ID NO: 810 - DNA, 97 bp, Artificial Sequence
  Synthetic: Hsa218R
actcactggtgctaacactccagtcctgcctatcagcggtttatccccgctggcgcggggaactctggctgcctgctccgagagagattccattcag

SEQ ID NO: 811 - DNA, 97 bp, Artificial Sequence
  Synthetic: Hsa219R
actcgagagaagccactcgctgggacagtcatctttcggtttatccccgctggcgcggggaactcgttctttgcaagcagcgcatggctgatggcag

SEQ ID NO: 812 - DNA, 97 bp, Artificial Sequence
  Synthetic: Hsa220R
actctgctggccgtccttctcccaggtgatgaggggcggtttatccccgctggcgcggggaactcaggcagaggaagctgcacttcgtggtgggggg

SEQ ID NO: 813 - DNA, 97 bp, Artificial Sequence
  Synthetic: Hsa221R
actcttcccttggcagttgagcacgcgcaggctgcgcggtttatccccgctggcgcggggaactctgttcgtcgagcaggccagcaagtgtgacagt

SEQ ID NO: 814 - DNA, 97 bp, Artificial Sequence
  Synthetic: Hsa222R
actcgggccaggccagcagccccggaaaggcggaagcggtttatccccgctggcgcggggaactcgtgtctggggagggtcaagggctggggctgag

SEQ ID NO: 815 - DNA, 97 bp, Artificial Sequence
  Synthetic: Hsa223R
actcgaggacagacccaaaagataaatgtctgcttgcggtttatccccgctggcgcggggaactccccaggcctgattcactggcctggcggagatg

SEQ ID NO: 816 - DNA, 97 bp, Artificial Sequence
  Synthetic: Hsa224R
actcgcagccagccaatcaggctcctgctaatcagacggtttatccccgctggcgcggggaactcgctctgctgctcgctcgcctttctttttcgtc

SEQ ID NO: 817 - protein, 5 aa, Artificial Sequence
  Synthetic: Linker
GGGGS

SEQ ID NO: 818 - protein, 8 aa, Artificial Sequence
  Synthetic: Linker
TGPGAAAR

SEQ ID NO: 819 - protein, 10 aa, Artificial Sequence
  Synthetic: Linker
GGSGSSGGSG

SEQ ID NO: 820 - protein, 15 aa, Artificial Sequence
  Synthetic: Linker
GGSGSSGGSGSSGGS

SEQ ID NO: 821 - protein, 17 aa, Artificial Sequence
  Synthetic: Linker
ADPTNRAKGLEAVSVAS

SEQ ID NO: 822 - protein, 20 aa, Artificial Sequence
  Synthetic: Linker
SGSETPGTSESATPESGGSG

SEQ ID NO: 823 - protein, 40 aa, Artificial Sequence
  Synthetic: Linker
SGSETPGTSESATPESGGSGSSGGSGSSGGSGSSGGSGSS

SEQ ID NO: 824 - protein, 50 aa, Artificial Sequence
  Synthetic: Linker
SGSETPGTSESATPESGGSGSSGGSGSSGGSGSSGGSGSSGGSGSSGGSG

SEQ ID NO: 825 - DNA, 50 bp, Artificial Sequence
  Synthetic: Hsa129_F_ilmn (Illumina)
cactctttccctacacgacgctcttccgatctgaccttggcacccacaag

SEQ ID NO: 826 - DNA, 52 bp, Artificial Sequence
  Synthetic: Hsa130_F_ilmn (Illumina)
cactctttccctacacgacgctcttccgatcttgctctggtttcatgtttgg

SEQ ID NO: 827 - DNA, 50 bp, Artificial Sequence
  Synthetic: Hsa131_F_ilmn (Illumina)
cactctttccctacacgacgctcttccgatctccagcagctctcagcctc

SEQ ID NO: 828 - DNA, 52 bp, Artificial Sequence
  Synthetic: Hsa132_F_ilmn (Illumina)
cactctttccctacacgacgctcttccgatctctccacccttgacttggcta

SEQ ID NO: 829 - DNA, 51 bp, Artificial Sequence
  Synthetic: Hsa133_F_ilmn (Illumina)
cactctttccctacacgacgctcttccgatctcaggagctccagtgacagc

SEQ ID NO: 830 - DNA, 52 bp, Artificial Sequence; identical to SEQ ID NO: 826
  Synthetic: Hsa134_F_ilmn (Illumina)

SEQ ID NO: 831 - DNA, 55 bp, Artificial Sequence
  Synthetic: Hsa135_F_ilmn (Illumina)
cactctttccctacacgacgctcttccgatcttttaaggtatggaagtcagtgcc

SEQ ID NO: 832 - DNA, 52 bp, Artificial Sequence
  Synthetic: Hsa136_F_ilmn (Illumina)
cactctttccctacacgacgctcttccgatctttgcttctgtaggtgggagg

SEQ ID NO: 833 - DNA, 52 bp, Artificial Sequence
  Synthetic: Hsa137_F_ilmn (Illumina)
cactctttccctacacgacgctcttccgatctgtggtgctgaaggaggagac

SEQ ID NO: 834 - DNA, 52 bp, Artificial Sequence; identical to SEQ ID NO: 833
  Synthetic: Hsa138_F_ilmn (Illumina)

SEQ ID NO: 835 - DNA, 52 bp, Artificial Sequence
  Synthetic: Hsa139_F_ilmn (Illumina)
cactctttccctacacgacgctcttccgatcttcaatcctcaggtctccacc

SEQ ID NO: 836 - DNA, 52 bp, Artificial Sequence
  Synthetic: Hsa140_F_ilmn (Illumina)
cactctttccctacacgacgctcttccgatctccagtgttccagaacgtgtg

SEQ ID NO: 837 - DNA, 52 bp, Artificial Sequence
  Synthetic: Hsa141_F_ilmn (Illumina)
cactctttccctacacgacgctcttccgatctccatctttcaccattcaccc

SEQ ID NO: 838 - DNA, 52 bp, Artificial Sequence
  Synthetic: Hsa142_F_ilmn (Illumina)
cactctttccctacacgacgctcttccgatctgggcatttcaccattcaaac

SEQ ID NO: 839 - DNA, 52 bp, Artificial Sequence; identical to SEQ ID NO: 832
  Synthetic: Hsa143_F_ilmn (Illumina)

SEQ ID NO: 840 - DNA, 52 bp, Artificial Sequence
  Synthetic: Hsa144_F_ilmn (Illumina)
cactctttccctacacgacgctcttccgatctgaggcagcaatttacccaaa

SEQ ID NO: 841 - DNA, 51 bp, Artificial Sequence; identical to SEQ ID NO: 829
  Synthetic: Hsa145_F_ilmn (Illumina)

SEQ ID NO: 842 - DNA, 52 bp, Artificial Sequence
  Synthetic: Hsa146_F_ilmn (Illumina)
cactctttccctacacgacgctcttccgatcttgtgctagcaacacccaaag

SEQ ID NO: 843 - DNA, 52 bp, Artificial Sequence
  Synthetic: Hsa147_F_ilmn (Illumina)
cactctttccctacacgacgctcttccgatcttgttcactcaagtgccaagc

SEQ ID NO: 844 - DNA, 52 bp, Artificial Sequence; identical to SEQ ID NO: 836
  Synthetic: Hsa148_F_ilmn (Illumina)

SEQ ID NO: 845 - DNA, 52 bp, Artificial Sequence; identical to SEQ ID NO: 833
  Synthetic: Hsa149_F_ilmn (Illumina)

SEQ ID NO: 846 - DNA, 50 bp, Artificial Sequence; identical to SEQ ID NO: 825
  Synthetic: Hsa150_F_ilmn (Illumina)

SEQ ID NO: 847 - DNA, 52 bp, Artificial Sequence
  Synthetic: Hsa151_F_ilmn (Illumina)
cactctttccctacacgacgctcttccgatctagcaccgcactgtcacatta

SEQ ID NO: 848 - DNA, 55 bp, Artificial Sequence
  Synthetic: Hsa152_F_ilmn (Illumina)
cactctttccctacacgacgctcttccgatctaatcccagattggttctaacctc

SEQ ID NO: 849 - DNA, 51 bp, Artificial Sequence
  Synthetic: Hsa153_F_ilmn (Illumina)
cactctttccctacacgacgctcttccgatctgacagcaacctctcccctg

SEQ ID NO: 850 - DNA, 52 bp, Artificial Sequence
  Synthetic: Hsa154_F_ilmn (Illumina)
cactctttccctacacgacgctcttccgatctagtgtgacagtcatggcacc

SEQ ID NO: 851 - DNA, 52 bp, Artificial Sequence
  Synthetic: Hsa155_F_ilmn (Illumina)
cactctttccctacacgacgctcttccgatctgtcagcactacaggcagcac

SEQ ID NO: 852 - DNA, 52 bp, Artificial Sequence
  Synthetic: Hsa156_F_ilmn (Illumina)
cactctttccctacacgacgctcttccgatcttctgtcctcctggctttgtt

SEQ ID NO: 853 - DNA, 52 bp, Artificial Sequence; identical to SEQ ID NO: 833
  Synthetic: Hsa157_F_ilmn (Illumina)

SEQ ID NO: 854 - DNA, 52 bp, Artificial Sequence; identical to SEQ ID NO: 835
  Synthetic: Hsa158_F_ilmn (Illumina)

SEQ ID NO: 855 - DNA, 52 bp, Artificial Sequence; identical to SEQ ID NO: 826
  Synthetic: Hsa159_F_ilmn (Illumina)

SEQ ID NO: 856 - DNA, 52 bp, Artificial Sequence
  Synthetic: Hsa160_F_ilmn (Illumina)
cactctttccctacacgacgctcttccgatcttcggcctacagaccagagac

SEQ ID NO: 857 - DNA, 50 bp, Artificial Sequence; identical to SEQ ID NO: 825
  Synthetic: Hsa161_F_ilmn (Illumina)

SEQ ID NO: 858 - DNA, 52 bp, Artificial Sequence; identical to SEQ ID NO: 836
  Synthetic: Hsa162_F_ilmn (Illumina)

SEQ ID NO: 859 - DNA, 52 bp, Artificial Sequence
  Synthetic: Hsa163_F_ilmn (Illumina)
cactctttccctacacgacgctcttccgatctactgacgcatcacatcttgg

SEQ ID NO: 860 - DNA, 52 bp, Artificial Sequence
  Synthetic: Hsa164_F_ilmn (Illumina)
cactctttccctacacgacgctcttccgatctatctcgctgctgtggaactt

SEQ ID NO: 861 - DNA, 52 bp, Artificial Sequence; identical to SEQ ID NO: 826
  Synthetic: Hsa165_F_ilmn (Illumina)

SEQ ID NO: 862 - DNA, 52 bp, Artificial Sequence; identical to SEQ ID NO: 832
  Synthetic: Hsa166_F_ilmn (Illumina)

SEQ ID NO: 863 - DNA, 52 bp, Artificial Sequence
  Synthetic: Hsa167_F_ilmn (Illumina)
cactctttccctacacgacgctcttccgatcttaggacctttgctgctccac

SEQ ID NO: 864 - DNA, 52 bp, Artificial Sequence
  Synthetic: Hsa168_F_ilmn (Illumina)
cactctttccctacacgacgctcttccgatctaatcctcattaagccgagca

SEQ ID NO: 865 - DNA, 52 bp, Artificial Sequence
  Synthetic: Hsa169_F_ilmn (Illumina)
cactctttccctacacgacgctcttccgatctgtctgagcctggaggagtga

SEQ ID NO: 866 - DNA, 52 bp, Artificial Sequence
  Synthetic: Hsa170_F_ilmn (Illumina)
cactctttccctacacgacgctcttccgatctacaaatgtcgccttggaaag

SEQ ID NO: 867 - DNA, 52 bp, Artificial Sequence
  Synthetic: Hsa171_F_ilmn (Illumina)
cactctttccctacacgacgctcttccgatctgggtctttctcatgtggtcc

SEQ ID NO: 868 - DNA, 52 bp, Artificial Sequence
  Synthetic: Hsa172_F_ilmn (Illumina)
cactctttccctacacgacgctcttccgatctactctgctctatgccaggct

SEQ ID NO: 869 - DNA, 52 bp, Artificial Sequence; identical to SEQ ID NO: 833
  Synthetic: Hsa173_F_ilmn (Illumina)

SEQ ID NO: 870 - DNA, 51 bp, Artificial Sequence; identical to SEQ ID NO: 829
  Synthetic: Hsa174_F_ilmn (Illumina)

SEQ ID NO: 871 - DNA, 52 bp, Artificial Sequence; identical to SEQ ID NO: 838
  Synthetic: Hsa175_F_ilmn (Illumina)

SEQ ID NO: 872 - DNA, 52 bp, Artificial Sequence
  Synthetic: Hsa176_F_ilmn (Illumina)
cactctttccctacacgacgctcttccgatctagaagcaggtgatttccgag

SEQ ID NO: 873 - DNA, 50 bp, Artificial Sequence; identical to SEQ ID NO: 825
  Synthetic: Hsa177_F_ilmn (Illumina)

SEQ ID NO: 874 - DNA, 52 bp, Artificial Sequence
  Synthetic: Hsa178_F_ilmn (Illumina)
cactctttccctacacgacgctcttccgatctgctgataggcaggactggag

SEQ ID NO: 875 - DNA, 52 bp, Artificial Sequence
  Synthetic: Hsa179_F_ilmn (Illumina)
cactctttccctacacgacgctcttccgatctacaccctgaggttccttcct

SEQ ID NO: 876 - DNA, 52 bp, Artificial Sequence
  Synthetic: Hsa180_F_ilmn (Illumina)
cactctttccctacacgacgctcttccgatctaggcacacaacattgcagaa

SEQ ID NO: 877 - DNA, 52 bp, Artificial Sequence; identical to SEQ ID NO: 838
  Synthetic: Hsa181_F_ilmn (Illumina)

SEQ ID NO: 878 - DNA, 52 bp, Artificial Sequence
  Synthetic: Hsa182_F_ilmn (Illumina)
cactctttccctacacgacgctcttccgatctatgaaatgtgcttgcctgtg

SEQ ID NO: 879 - DNA, 52 bp, Artificial Sequence; identical to SEQ ID NO: 836
  Synthetic: Hsa183_F_ilmn (Illumina)

SEQ ID NO: 880 - DNA, 52 bp, Artificial Sequence
  Synthetic: Hsa184_F_ilmn (Illumina)
cactctttccctacacgacgctcttccgatctcatacagactcgcaggcaga

SEQ ID NO: 881 - DNA, 50 bp, Artificial Sequence; identical to SEQ ID NO: 825
  Synthetic: Hsa185_F_ilmn (Illumina)

SEQ ID NO: 882 - DNA, 52 bp, Artificial Sequence; identical to SEQ ID NO: 835
  Synthetic: Hsa186_F_ilmn (Illumina)

SEQ ID NO: 883 - DNA, 52 bp, Artificial Sequence; identical to SEQ ID NO: 874
  Synthetic: Hsa187_F_ilmn (Illumina)

SEQ ID NO: 884 - DNA, 52 bp, Artificial Sequence; identical to SEQ ID NO: 832
  Synthetic: Hsa188_F_ilmn (Illumina)

SEQ ID NO: 885 - DNA, 52 bp, Artificial Sequence
  Synthetic: Hsa189_F_ilmn (Illumina)
cactctttccctacacgacgctcttccgatctcttctgcaggccttgaagtt

SEQ ID NO: 886 - DNA, 52 bp, Artificial Sequence
  Synthetic: Hsa190_F_ilmn (Illumina)
cactctttccctacacgacgctcttccgatctgcaggaactgagccagaaac

SEQ ID NO: 887 - DNA, 52 bp, Artificial Sequence; identical to SEQ ID NO: 832
  Synthetic: Hsa191_F_ilmn (Illumina)

SEQ ID NO: 888 - DNA, 52 bp, Artificial Sequence; identical to SEQ ID NO: 856
  Synthetic: Hsa192_F_ilmn (Illumina)

SEQ ID NO: 889 - DNA, 52 bp, Artificial Sequence; identical to SEQ ID NO: 852
  Synthetic: Hsa193_F_ilmn (Illumina)

SEQ ID NO: 890 - DNA, 52 bp, Artificial Sequence; identical to SEQ ID NO: 874
  Synthetic: Hsa194_F_ilmn (Illumina)

SEQ ID NO: 891 - DNA, 55 bp, Artificial Sequence; identical to SEQ ID NO: 848
  Synthetic: Hsa195_F_ilmn (Illumina)

SEQ ID NO: 892 - DNA, 52 bp, Artificial Sequence; identical to SEQ ID NO: 875
  Synthetic: Hsa196_F_ilmn (Illumina)

SEQ ID NO: 893 - DNA, 52 bp, Artificial Sequence
  Synthetic: Hsa197_F_ilmn (Illumina)
cactctttccctacacgacgctcttccgatctcatgtggtccttgtgttcgt

SEQ ID NO: 894 - DNA, 52 bp, Artificial Sequence
  Synthetic: Hsa198_F_ilmn (Illumina)
cactctttccctacacgacgctcttccgatctggtaacagtgaggctgggaa

SEQ ID NO: 895 - DNA, 52 bp, Artificial Sequence
  Synthetic: Hsa199_F_ilmn (Illumina)
cactctttccctacacgacgctcttccgatctggtctgtcctctctgttgcc

SEQ ID NO: 896 - DNA, 52 bp, Artificial Sequence; identical to SEQ ID NO: 836
  Synthetic: Hsa200_F_ilmn (Illumina)

SEQ ID NO: 897 - DNA, 50 bp, Artificial Sequence; identical to SEQ ID NO: 825
  Synthetic: Hsa201_F_ilmn (Illumina)

SEQ ID NO: 898 - DNA, 52 bp, Artificial Sequence
  Synthetic: Hsa202_F_ilmn (Illumina)
cactctttccctacacgacgctcttccgatctcaaggctttgcctacgagtc

SEQ ID NO: 899 - DNA, 52 bp, Artificial Sequence
  Synthetic: Hsa203_F_ilmn (Illumina)
cactctttccctacacgacgctcttccgatctggaaattggcaagtggagtc

SEQ ID NO: 900 - DNA, 52 bp, Artificial Sequence; identical to SEQ ID NO: 836
  Synthetic: Hsa204_F_ilmn (Illumina)

SEQ ID NO: 901 - DNA, 52 bp, Artificial Sequence; identical to SEQ ID NO: 886
  Synthetic: Hsa205_F_ilmn (Illumina)

SEQ ID NO: 902 - DNA, 52 bp, Artificial Sequence; identical to SEQ ID NO: 832
  Synthetic: Hsa206_F_ilmn (Illumina)

SEQ ID NO: 903 - DNA, 52 bp, Artificial Sequence; identical to SEQ ID NO: 836
  Synthetic: Hsa207_F_ilmn (Illumina)

SEQ ID NO: 904 - DNA, 50 bp, Artificial Sequence; identical to SEQ ID NO: 827
  Synthetic: Hsa208_F_ilmn (Illumina)

SEQ ID NO: 905 - DNA, 51 bp, Artificial Sequence; identical to SEQ ID NO: 829
  Synthetic: Hsa209_F_ilmn (Illumina)

SEQ ID NO: 906 - DNA, 52 bp, Artificial Sequence; identical to SEQ ID NO: 894
  Synthetic: Hsa210_F_ilmn (Illumina)

SEQ ID NO: 907 - DNA, 52 bp, Artificial Sequence; identical to SEQ ID NO: 852
  Synthetic: Hsa211_F_ilmn (Illumina)

SEQ ID NO: 908 - DNA, 52 bp, Artificial Sequence; identical to SEQ ID NO: 878
  Synthetic: Hsa212_F_ilmn (Illumina)

SEQ ID NO: 909 - DNA, 52 bp, Artificial Sequence; identical to SEQ ID NO: 865
  Synthetic: Hsa213_F_ilmn (Illumina)

SEQ ID NO: 910 - DNA, 52 bp, Artificial Sequence; identical to SEQ ID NO: 885
  Synthetic: Hsa214_F_ilmn (Illumina)

SEQ ID NO: 911 - DNA, 52 bp, Artificial Sequence; identical to SEQ ID NO: 838
  Synthetic: Hsa215_F_ilmn (Illumina)

SEQ ID NO: 912 - DNA, 52 bp, Artificial Sequence; identical to SEQ ID NO: 894
  Synthetic: Hsa216_F_ilmn (Illumina)

SEQ ID NO: 913 - DNA, 52 bp, Artificial Sequence; identical to SEQ ID NO: 886
  Synthetic: Hsa217_F_ilmn (Illumina)

SEQ ID NO: 914 - DNA, 52 bp, Artificial Sequence; identical to SEQ ID NO: 852
  Synthetic: Hsa218_F_ilmn (Illumina)

SEQ ID NO: 915 - DNA, 52 bp, Artificial Sequence; identical to SEQ ID NO: 836
  Synthetic: Hsa219_F_ilmn (Illumina)

SEQ ID NO: 916 - DNA, 52 bp, Artificial Sequence
  Synthetic: Hsa220_F_ilmn (Illumina)
cactctttccctacacgacgctcttccgatctccgccaggaaggtctacata

SEQ ID NO: 917 - DNA, 52 bp, Artificial Sequence; identical to SEQ ID NO: 893
  Synthetic: Hsa221_F_ilmn (Illumina)

SEQ ID NO: 918 - DNA, 51 bp, Artificial Sequence; identical to SEQ ID NO: 829
  Synthetic: Hsa222_F_ilmn (Illumina)

SEQ ID NO: 919 - DNA, 52 bp, Artificial Sequence; identical to SEQ ID NO: 894
  Synthetic: Hsa223_F_ilmn (Illumina)

SEQ ID NO: 920 - DNA, 52 bp, Artificial Sequence
  Synthetic: Hsa224_F_ilmn (Illumina)
cactctttccctacacgacgctcttccgatctatttcccttctcgctctgct

SEQ ID NO: 921 - DNA, 48 bp, Artificial Sequence
  Synthetic: Hsa129_R_ilmn (Illumina)
ggagttcagacgtgtgctcttccgatctgtggtggcacaaactgacac

SEQ ID NO: 922 - DNA, 48 bp, Artificial Sequence
  Synthetic: Hsa130_R_ilmn (Illumina)
ggagttcagacgtgtgctcttccgatctcaaccagggttgttcctttg

SEQ ID NO: 923 - DNA, 48 bp, Artificial Sequence
  Synthetic: Hsa131_R_ilmn (Illumina)
ggagttcagacgtgtgctcttccgatctgtgtgacttgggccagatgt

SEQ ID NO: 924 - DNA, 48 bp, Artificial Sequence
  Synthetic: Hsa132_R_ilmn (Illumina)
ggagttcagacgtgtgctcttccgatctactcagcaccatctttccgt

SEQ ID NO: 925 - DNA, 48 bp, Artificial Sequence
  Synthetic: Hsa133_R_ilmn (Illumina)
ggagttcagacgtgtgctcttccgatctggcacccagagtgagtgagt

SEQ ID NO: 926 - DNA, 48 bp, Artificial Sequence; identical to SEQ ID NO: 922
  Synthetic: Hsa134_R_ilmn (Illumina)

SEQ ID NO: 927 - DNA, 50 bp, Artificial Sequence
  Synthetic: Hsa135_R_ilmn (Illumina)
ggagttcagacgtgtgctcttccgatctgactacaattcccaattcccaa

SEQ ID NO: 928 - DNA, 48 bp, Artificial Sequence
  Synthetic: Hsa136_R_ilmn (Illumina)
ggagttcagacgtgtgctcttccgatctgaaggcacagttaccggaga

SEQ ID NO: 929 - DNA, 48 bp, Artificial Sequence
  Synthetic: Hsa137_R_ilmn (Illumina)
ggagttcagacgtgtgctcttccgatctagcaatgggcctactaagca

SEQ ID NO: 930 - DNA, 48 bp, Artificial Sequence; identical to SEQ ID NO: 929
  Synthetic: Hsa138_R_ilmn (Illumina)

SEQ ID NO: 931 - DNA, 48 bp, Artificial Sequence
  Synthetic: Hsa139_R_ilmn (Illumina)
ggagttcagacgtgtgctcttccgatctctgtctccagcctctggcta

SEQ ID NO: 932 - DNA, 49 bp, Artificial Sequence
  Synthetic: Hsa140_R_ilmn (Illumina)
ggagttcagacgtgtgctcttccgatctttcattctcttcggaggaaca

SEQ ID NO: 933 - DNA, 47 bp, Artificial Sequence
  Synthetic: Hsa141_R_ilmn (Illumina)
ggagttcagacgtgtgctcttccgatctaccctgccatcctgcttac

SEQ ID NO: 934 - DNA, 48 bp, Artificial Sequence
  Synthetic: Hsa142_R_ilmn (Illumina)
ggagttcagacgtgtgctcttccgatctagcacctttcacactcaccc

SEQ ID NO: 935 - DNA, 48 bp, Artificial Sequence; identical to SEQ ID NO: 928
  Synthetic: Hsa143_R_ilmn (Illumina)

SEQ ID NO: 936 - DNA, 48 bp, Artificial Sequence
  Synthetic: Hsa144_R_ilmn (Illumina)
ggagttcagacgtgtgctcttccgatcttacgagggctcctctgacac

SEQ ID NO: 937 - DNA, 48 bp, Artificial Sequence; identical to SEQ ID NO: 925
  Synthetic: Hsa145_R_ilmn (Illumina)

SEQ ID NO: 938 - DNA, 48 bp, Artificial Sequence
  Synthetic: Hsa146_R_ilmn (Illumina)
ggagttcagacgtgtgctcttccgatctgtttctggctcagttcctgc

SEQ ID NO: 939 - DNA, 50 bp, Artificial Sequence
  Synthetic: Hsa147_R_ilmn (Illumina)
ggagttcagacgtgtgctcttccgatctcaaagacattgaaaccctctgg

SEQ ID NO: 940 - DNA, 49 bp, Artificial Sequence; identical to SEQ ID NO: 932
  Synthetic: Hsa148_R_ilmn (Illumina)

SEQ ID NO: 941 - DNA, 48 bp, Artificial Sequence; identical to SEQ ID NO: 929
  Synthetic: Hsa149_R_ilmn (Illumina)

SEQ ID NO: 942 - DNA, 48 bp, Artificial Sequence; identical to SEQ ID NO: 921
  Synthetic: Hsa150_R_ilmn (Illumina)

SEQ ID NO: 943 - DNA, 48 bp, Artificial Sequence
  Synthetic: Hsa151_R_ilmn (Illumina)
ggagttcagacgtgtgctcttccgatcttttcctcacagaagccaaca

SEQ ID NO: 944 - DNA, 50 bp, Artificial Sequence
  Synthetic: Hsa152_R_ilmn (Illumina)
ggagttcagacgtgtgctcttccgatctccatgaaagctacaaccagtga

SEQ ID NO: 945 - DNA, 46 bp, Artificial Sequence
  Synthetic: Hsa153_R_ilmn (Illumina)
ggagttcagacgtgtgctcttccgatctatccctacacccgcacct

SEQ ID NO: 946 - DNA, 48 bp, Artificial Sequence
  Synthetic: Hsa154_R_ilmn (Illumina)
ggagttcagacgtgtgctcttccgatctgatggagagagaccagcgtc

SEQ ID NO: 947 - DNA, 47 bp, Artificial Sequence
  Synthetic: Hsa155_R_ilmn (Illumina)
ggagttcagacgtgtgctcttccgatctcatggagggctgagagagg

SEQ ID NO: 948 - DNA, 48 bp, Artificial Sequence
  Synthetic: Hsa156_R_ilmn (Illumina)
ggagttcagacgtgtgctcttccgatctcggaatcagaatcggacact

SEQ ID NO: 949 - DNA, 48 bp, Artificial Sequence; identical to SEQ ID NO: 929
  Synthetic: Hsa157_R_ilmn (Illumina)

SEQ ID NO: 950 - DNA, 48 bp, Artificial Sequence
  Synthetic: Hsa158_R_ilmn (Illumina)
ggagttcagacgtgtgctcttccgatcttccagaaagctaagcctcca

SEQ ID NO: 951 - DNA, 48 bp, Artificial Sequence; identical to SEQ ID NO: 922
  Synthetic: Hsa159_R_ilmn (Illumina)

SEQ ID NO: 952 - DNA, 48 bp, Artificial Sequence
  Synthetic: Hsa160_R_ilmn (Illumina)
ggagttcagacgtgtgctcttccgatctccactctgagagagcatccc

SEQ ID NO: 953 - DNA, 48 bp, Artificial Sequence; identical to SEQ ID NO: 921
  Synthetic: Hsa161_R_ilmn (Illumina)

SEQ ID NO: 954 - DNA, 49 bp, Artificial Sequence; identical to SEQ ID NO: 932
  Synthetic: Hsa162_R_ilmn (Illumina)

SEQ ID NO: 955 - DNA, 48 bp, Artificial Sequence
  Synthetic: Hsa163_R_ilmn (Illumina)
ggagttcagacgtgtgctcttccgatctattcccaagtgggctttctt

SEQ ID NO: 956 - DNA, 48 bp, Artificial Sequence
  Synthetic: Hsa164_R_ilmn (Illumina)
ggagttcagacgtgtgctcttccgatcttttcctttcccaacatcctg

SEQ ID NO: 957 - DNA, 48 bp, Artificial Sequence; identical to SEQ ID NO: 922
  Synthetic: Hsa165_R_ilmn (Illumina)

SEQ ID NO: 958 - DNA, 48 bp, Artificial Sequence; identical to SEQ ID NO: 928
  Synthetic: Hsa166_R_ilmn (Illumina)

SEQ ID NO: 959 - DNA, 49 bp, Artificial Sequence
  Synthetic: Hsa167_R_ilmn (Illumina)
ggagttcagacgtgtgctcttccgatctaatactacatgccggaggacc

SEQ ID NO: 960 - DNA, 49 bp, Artificial Sequence
  Synthetic: Hsa168_R_ilmn (Illumina)
ggagttcagacgtgtgctcttccgatctcctgtccacagctcactaggt

SEQ ID NO: 961 - DNA, 47 bp, Artificial Sequence
  Synthetic: Hsa169_R_ilmn (Illumina)
ggagttcagacgtgtgctcttccgatctgtcctggcgaggagaccta

SEQ ID NO: 962 - DNA, 48 bp, Artificial Sequence
  Synthetic: Hsa170_R_ilmn (Illumina)
ggagttcagacgtgtgctcttccgatctcgtgcttacctgtctgtgga

SEQ ID NO: 963 - DNA, 48 bp, Artificial Sequence; identical to SEQ ID NO: 946
  Synthetic: Hsa171_R_ilmn (Illumina)

SEQ ID NO: 964 - DNA, 48 bp, Artificial Sequence; identical to SEQ ID NO: 938
  Synthetic: Hsa172_R_ilmn (Illumina)

SEQ ID NO: 965 - DNA, 48 bp, Artificial Sequence; identical to SEQ ID NO: 929
  Synthetic: Hsa173_R_ilmn (Illumina)

SEQ ID NO: 966 - DNA, 48 bp, Artificial Sequence; identical to SEQ ID NO: 925
  Synthetic: Hsa174_R_ilmn (Illumina)

SEQ ID NO: 967 - DNA, 48 bp, Artificial Sequence; identical to SEQ ID NO: 934
  Synthetic: Hsa175_R_ilmn (Illumina)

SEQ ID NO: 968 - DNA, 48 bp, Artificial Sequence
  Synthetic: Hsa176_R_ilmn (Illumina)
ggagttcagacgtgtgctcttccgatctttggcataaaccactgatgc

SEQ ID NO: 969 - DNA, 48 bp, Artificial Sequence; identical to SEQ ID NO: 921
  Synthetic: Hsa177_R_ilmn (Illumina)

SEQ ID NO: 970 - DNA, 48 bp, Artificial Sequence
  Synthetic: Hsa178_R_ilmn (Illumina)
ggagttcagacgtgtgctcttccgatctgcatttaccaggagcaggaa

SEQ ID NO: 971 - DNA, 48 bp, Artificial Sequence
  Synthetic: Hsa179_R_ilmn (Illumina)
ggagttcagacgtgtgctcttccgatcttaatgtgacggcaatggaga

SEQ ID NO: 972 - DNA, 48 bp, Artificial Sequence
  Synthetic: Hsa180_R_ilmn (Illumina)
ggagttcagacgtgtgctcttccgatctacaggcaggacgttgactct

SEQ ID NO: 973 - DNA, 48 bp, Artificial Sequence; identical to SEQ ID NO: 934
  Synthetic: Hsa181_R_ilmn (Illumina)

SEQ ID NO: 974 - DNA, 48 bp, Artificial Sequence
  Synthetic: Hsa182_R_ilmn (Illumina)
ggagttcagacgtgtgctcttccgatctagggctcaccttgacaatga

SEQ ID NO: 975 - DNA, 49 bp, Artificial Sequence; identical to SEQ ID NO: 932
  Synthetic: Hsa183_R_ilmn (Illumina)

SEQ ID NO: 976 - DNA, 47 bp, Artificial Sequence
  Synthetic: Hsa184_R_ilmn (Illumina)
ggagttcagacgtgtgctcttccgatctgctgagcaggtgtagacgc

SEQ ID NO: 977 - DNA, 48 bp, Artificial Sequence; identical to SEQ ID NO: 921
  Synthetic: Hsa185_R_ilmn (Illumina)

SEQ ID NO: 978 - DNA, 48 bp, Artificial Sequence; identical to SEQ ID NO: 931
  Synthetic: Hsa186_R_ilmn (Illumina)

SEQ ID NO: 979 - DNA, 48 bp, Artificial Sequence; identical to SEQ ID NO: 970
  Synthetic: Hsa187_R_ilmn (Illumina)

SEQ ID NO: 980 - DNA, 48 bp, Artificial Sequence; identical to SEQ ID NO: 928
  Synthetic: Hsa188_R_ilmn (Illumina)

SEQ ID NO: 981 - DNA, 48 bp, Artificial Sequence
  Synthetic: Hsa189_R_ilmn (Illumina)
ggagttcagacgtgtgctcttccgatctatggattcagctcagatggg

SEQ ID NO: 982 - DNA, 48 bp, Artificial Sequence
  Synthetic: Hsa190_R_ilmn (Illumina)
ggagttcagacgtgtgctcttccgatctgaatcaggcctgggtgataa

SEQ ID NO: 983 - DNA, 48 bp, Artificial Sequence; identical to SEQ ID NO: 928
  Synthetic: Hsa191_R_ilmn (Illumina)

SEQ ID NO: 984 - DNA, 48 bp, Artificial Sequence; identical to SEQ ID NO: 952
  Synthetic: Hsa192_R_ilmn (Illumina)

SEQ ID NO: 985 - DNA, 48 bp, Artificial Sequence; identical to SEQ ID NO: 948
  Synthetic: Hsa193_R_ilmn (Illumina)

SEQ ID NO: 986 - DNA, 48 bp, Artificial Sequence; identical to SEQ ID NO: 970
  Synthetic: Hsa194_R_ilmn (Illumina)

SEQ ID NO: 987 - DNA, 50 bp, Artificial Sequence; identical to SEQ ID NO: 944
  Synthetic: Hsa195_R_ilmn (Illumina)

SEQ ID NO: 988 - DNA, 48 bp, Artificial Sequence; identical to SEQ ID NO: 971
  Synthetic: Hsa196_R_ilmn (Illumina)

SEQ ID NO: 989 - DNA, 48 bp, Artificial Sequence; identical to SEQ ID NO: 946
  Synthetic: Hsa197_R_ilmn (Illumina)

SEQ ID NO: 990 - DNA, 48 bp, Artificial Sequence
  Synthetic: Hsa198_R_ilmn (Illumina)
ggagttcagacgtgtgctcttccgatctgcaacagagaggacagaccc

SEQ ID NO: 991 - DNA, 47 bp, Artificial Sequence
  Synthetic: Hsa199_R_ilmn (Illumina)
ggagttcagacgtgtgctcttccgatctgcatcaccctaggcagtca

SEQ ID NO: 992 - DNA, 49 bp, Artificial Sequence; identical to SEQ ID NO: 932
  Synthetic: Hsa200_R_ilmn (Illumina)

SEQ ID NO: 993 - DNA, 48 bp, Artificial Sequence; identical to SEQ ID NO: 921
  Synthetic: Hsa201_R_ilmn (Illumina)

SEQ ID NO: 994 - DNA, 48 bp, Artificial Sequence
  Synthetic: Hsa202_R_ilmn (Illumina)
ggagttcagacgtgtgctcttccgatctgagtgggtacgatgcattcc

SEQ ID NO: 995 - DNA, 48 bp, Artificial Sequence
  Synthetic: Hsa203_R_ilmn (Illumina)
ggagttcagacgtgtgctcttccgatctgggcaattaaagcggttaca

SEQ ID NO: 996 - DNA, 49 bp, Artificial Sequence; identical to SEQ ID NO: 932
  Synthetic: Hsa204_R_ilmn (Illumina)

SEQ ID NO: 997 - DNA, 48 bp, Artificial Sequence; identical to SEQ ID NO: 982
  Synthetic: Hsa205_R_ilmn (Illumina)

SEQ ID NO: 998 - DNA, 48 bp, Artificial Sequence; identical to SEQ ID NO: 928
  Synthetic: Hsa206_R_ilmn (Illumina)

SEQ ID NO: 999 - DNA, 49 bp, Artificial Sequence; identical to SEQ ID NO: 932
  Synthetic: Hsa207_R_ilmn (Illumina)

SEQ ID NO: 1000 - DNA, 48 bp, Artificial Sequence
  Synthetic: Hsa208_R_ilmn (Illumina)
ggagttcagacgtgtgctcttccgatctccctcccaagaccaggttag

SEQ ID NO: 1001 - DNA, 48 bp, Artificial Sequence; identical to SEQ ID NO: 925
  Synthetic: Hsa209_R_ilmn (Illumina)

SEQ ID NO: 1002 - DNA, 48 bp, Artificial Sequence; identical to SEQ ID NO: 990
  Synthetic: Hsa210_R_ilmn (Illumina)

SEQ ID NO: 1003 - DNA, 48 bp, Artificial Sequence; identical to SEQ ID NO: 948
  Synthetic: Hsa211_R_ilmn (Illumina)

SEQ ID NO: 1004 - DNA, 48 bp, Artificial Sequence; identical to SEQ ID NO: 974
  Synthetic: Hsa212_R_ilmn (Illumina)

SEQ ID NO: 1005 - DNA, 48 bp, Artificial Sequence
  Synthetic: Hsa213_R_ilmn (Illumina)
ggagttcagacgtgtgctcttccgatctgaggagacctagaggccgtg

SEQ ID NO: 1006 - DNA, 48 bp, Artificial Sequence; identical to SEQ ID NO: 981
  Synthetic: Hsa214_R_ilmn (Illumina)

SEQ ID NO: 1007 - DNA, 48 bp, Artificial Sequence; identical to SEQ ID NO: 934
  Synthetic: Hsa215_R_ilmn (Illumina)

SEQ ID NO: 1008 - DNA, 48 bp, Artificial Sequence; identical to SEQ ID NO: 990
  Synthetic: Hsa216_R_ilmn (Illumina)

SEQ ID NO: 1009 - DNA, 48 bp, Artificial Sequence; identical to SEQ ID NO: 982
  Synthetic: Hsa217_R_ilmn (Illumina)

SEQ ID NO: 1010 - DNA, 48 bp, Artificial Sequence; identical to SEQ ID NO: 948
  Synthetic: Hsa218_R_ilmn (Illumina)

SEQ ID NO: 1011 - DNA, 49 bp, Artificial Sequence; identical to SEQ ID NO: 932
  Synthetic: Hsa219_R_ilmn (Illumina)

SEQ ID NO: 1012 - DNA, 48 bp, Artificial Sequence
  Synthetic: Hsa220_R_ilmn (Illumina)
ggagttcagacgtgtgctcttccgatctgcggtggatcttgagatagc

SEQ ID NO: 1013 - DNA, 48 bp, Artificial Sequence; identical to SEQ ID NO: 946
  Synthetic: Hsa221_R_ilmn (Illumina)

SEQ ID NO: 1014 - DNA, 48 bp, Artificial Sequence; identical to SEQ ID NO: 925
  Synthetic: Hsa222_R_ilmn (Illumina)

SEQ ID NO: 1015 - DNA, 48 bp, Artificial Sequence; identical to SEQ ID NO: 990
  Synthetic: Hsa223_R_ilmn (Illumina)

SEQ ID NO: 1016 - DNA, 48 bp, Artificial Sequence
  Synthetic: Hsa224_R_ilmn (Illumina)
ggagttcagacgtgtgctcttccgatctctccagtcctgcctatcagc

SEQ ID NO: 1017 - DNA, 97 bp, Artificial Sequence
  Synthetic: Hsa33F
accgagcgtttcctcacgtcacagtatgtctctggcgagttccccgcgccagcggggataaaccgtactaaaaatgtactgacctcctattaatgcc

SEQ ID NO: 1018 - DNA, 97 bp, Artificial Sequence
  Synthetic: Hsa36F
accgcctcattcgctgccaacctagccagcccagaagagttccccgcgccagcggggataaaccgtcgacagccacagacttgtctggcggagtttc

SEQ ID NO: 1019 - DNA, 97 bp, Artificial Sequence
  Synthetic: Hsa37F
accgtctgtggctgtcgacatgctaagtgagggcctgagttccccgcgccagcggggataaaccgtagtctcaagtttgttcaaagctggactcctc

SEQ ID NO: 1020 - DNA, 97 bp, Artificial Sequence
  Synthetic: Hsa38F
accgttggctgttatgaggacttcacagctggtgtcgagttccccgcgccagcggggataaaccgggaggaaggactcctccactggagaactgata

SEQ ID NO: 1021 - DNA, 97 bp, Artificial Sequence
  Synthetic: Hsa39F
accgaggtaatgcgtcggcccgggactacatctcccgagttccccgcgccagcggggataaaccgacggcaactcggttaagtcttcccccaccgcc

SEQ ID NO: 1022 - DNA, 97 bp, Artificial Sequence
  Synthetic: Hsa40F
accgatgcggtagtcgctgcagctagctgcccacctgagttccccgcgccagcggggataaaccggggaggcggggtaagggaagtaggtggaagat

SEQ ID NO: 1023 - DNA, 97 bp, Artificial Sequence
  Synthetic: Hsa42F
accggcaggaggaggtggagagagagtgggggaaaagagttccccgcgccagcggggataaaccgatgaaaaggcagtcaggtcttcagtagccaaa

SEQ ID NO: 1024 - DNA, 97 bp, Artificial Sequence
  Synthetic: Hsa43F
accgatgagtctaggttacattcagtgcaaaaaaccgagttccccgcgccagcggggataaaccggtaagtttttaaaatatatatctaccatgtat

SEQ ID NO: 1025 - DNA, 97 bp, Artificial Sequence
  Synthetic: Hsa44F
accgctttccttggagccaaatttaaaacctctgccgagttccccgcgccagcggggataaaccgctagggcctcggtgatggaaatccacttgtgc

SEQ ID NO: 1026 - DNA, 97 bp, Artificial Sequence
  Synthetic: Hsa45F
accgcatgacggacaagtacaggctgcacctgtcaggagttccccgcgccagcggggataaaccgaccaatccattgcccacaatgccagttaagaa

SEQ ID NO: 1027 - DNA, 97 bp, Artificial Sequence
  Synthetic: Hsa46F
accgacaagttttgggtctcagcgcaggcctcagttgagttccccgcgccagcggggataaaccgaggtctgtccagatgctaagaccaggtacttc

SEQ ID NO: 1028 - DNA, 97 bp, Artificial Sequence
  Synthetic: Hsa47F
accggtaatgtgtggggagcgggcgtcggaaggaccgagttccccgcgccagcggggataaaccgcacgaaggggttgggggatgctgggggtccgg

SEQ ID NO: 1029 - DNA, 97 bp, Artificial Sequence
  Synthetic: Hsa48F
accgcggcggctgagggtgacccagaaccgggtcccgagttccccgcgccagcggggataaaccgaaggccagttgtatggaccgtgtggtggtggt

SEQ ID NO: 1030 - DNA, 97 bp, Artificial Sequence
  Synthetic: Hsa49F
accgtatatctgcaaatttaataaatcaagagggaagagttccccgcgccagcggggataaaccgacaaatcacaaactggtgtgaatagagccagc

SEQ ID NO: 1031 - DNA, 97 bp, Artificial Sequence
  Synthetic: Hsa51F
accgaagactaagaggtagtttctgaacttctccccgagttccccgcgccagcggggataaaccgctgttctattttccagcaagaggctcccgagc

SEQ ID NO: 1032 - DNA, 97 bp, Artificial Sequence
  Synthetic: Hsa52F
accggactgaagaccaagcaacctggaaagaagtcggagttccccgcgccagcggggataaaccgtgtctgcaggagagcaaaacaaacttagccgt

SEQ ID NO: 1033 - DNA, 97 bp, Artificial Sequence
  Synthetic: Hsa53F
accgttggcctctctttggatccaataggcatttttgagttccccgcgccagcggggataaaccgcaggtattgacaaattttatataactttataa

SEQ ID NO: 1034 - DNA, 97 bp, Artificial Sequence
  Synthetic: Hsa56F
accgaaactacaacacctagtacccttggaagtaccgagttccccgcgccagcggggataaaccgttccctgggtaggtaactctggggtagcagta

SEQ ID NO: 1035 - DNA, 97 bp, Artificial Sequence
  Synthetic: Hsa58F
accgggatggcatgggagacaaggtactcctccagggagttccccgcgccagcggggataaaccggccttaacagaaatctcggattctctcctggg

SEQ ID NO: 1036 - DNA, 97 bp, Artificial Sequence
  Synthetic: Hsa59F
accgattggaattatcttctagctcttgtcgaagatgagttccccgcgccagcggggataaaccgaaggtatcaagactgtgacttttaattgtagt

SEQ ID NO: 1037 - DNA, 97 bp, Artificial Sequence
  Synthetic: Hsa60F
accgatgattggaattatcttctagctcttgtcgaagagttccccgcgccagcggggataaaccggtatcaagactgtgacttttaattgtagttta

SEQ ID NO: 1038 - DNA, 97 bp, Artificial Sequence
  Synthetic: Hsa62F
accgggaacagattttgtgcaaaactctgcagaaacgagttccccgcgccagcggggataaaccgcagttccaaggtcagtaaattactgaaaggta

SEQ ID NO: 1039 - DNA, 97 bp, Artificial Sequence
  Synthetic: Hsa63F
accggaatccagcttcttccaatttcttcacatcgtgagttccccgcgccagcggggataaaccggagctaataaatattaagggaattagtgaagc

SEQ ID NO: 1040 - DNA, 97 bp, Artificial Sequence
  Synthetic: Hsa67F
accgccagaggcccggcacccccgcacaggcgcctcgagttccccgcgccagcggggataaaccgaaggagcaattcctcttctgcccgcttggctg

SEQ ID NO: 1041 - DNA, 97 bp, Artificial Sequence
  Synthetic: Hsa68F
accggaagggtcgctctttgcagcttctttgaattcgagttccccgcgccagcggggataaaccgagctgatgtcaatgctatggactgcacaaaag

SEQ ID NO: 1042 - DNA, 97 bp, Artificial Sequence
  Synthetic: Hsa69F
accgaacaaaatcctctatgtctgtagacaactcttgagttccccgcgccagcggggataaaccgcaaggtaagccagcgactgctagatttttttt

SEQ ID NO: 1043 - DNA, 97 bp, Artificial Sequence
  Synthetic: Hsa72F
accgccagtggcactggggggtgccgcctcggggcagagttccccgcgccagcggggataaaccggccaggcccaggcgactggcggccaggtgtcc

SEQ ID NO: 1044 - DNA, 97 bp, Artificial Sequence
  Synthetic: Hsa74F
accgggctacagaaaccgtgccaaaagacttctacagagttccccgcgccagcggggataaaccgttcaggagagttattttccttttttgcaaaat

SEQ ID NO: 1045 - DNA, 97 bp, Artificial Sequence
  Synthetic: Hsa77F
accggatttcctaaaggaatttaacaacaagaccatgagttccccgcgccagcggggataaaccggttcctctgtctgatggacttattcaatgttt

SEQ ID NO: 1046 - DNA, 97 bp, Artificial Sequence
  Synthetic: Hsa78F
accgacggtggaaacgttctctactacgaagtgatggagttccccgcgccagcggggataaaccgaaatcagtaacatggaagtctcaaatatttca

SEQ ID NO: 1047 - DNA, 97 bp, Artificial Sequence
  Synthetic: Hsa82F
accgaattatgagatatggaaacagacgcatttttagagttccccgcgccagcggggataaaccgtgccaccaggtaaatatcaatttatttctttt

SEQ ID NO: 1048 - DNA, 97 bp, Artificial Sequence
  Synthetic: Hsa84F
accgtctttttaactctctcctgtagaatcttacatgagttccccgcgccagcggggataaaccgaagatatacaaaaagaaacagtttattgctta

SEQ ID NO: 1049 - DNA, 97 bp, Artificial Sequence
  Synthetic: Hsa87F
accggcttctctgattttggtaggctagaaatacgtgagttccccgcgccagcggggataaaccgaagagcagcatcttgaatctcatacagactgc

SEQ ID NO: 1050 - DNA, 97 bp, Artificial Sequence
  Synthetic: Hsa88F
accgatgctgctcttcatctctcttatttaccactggagttccccgcgccagcggggataaaccgcaggcaatatctggaacttctccagtggcttc

SEQ ID NO: 1051 - DNA, 97 bp, Artificial Sequence
  Synthetic: Hsa89F
accgtttttccaaatcctgttaaagtataaaacagagagttccccgcgccagcggggataaaccgaccacattggaaagtcaatgccaaatgtccta

SEQ ID NO: 1052 - DNA, 97 bp, Artificial Sequence
  Synthetic: Hsa92F
accggcagcagtcagtgggcagtggccccttgcagcgagttccccgcgccagcggggataaaccgcactctgactgcctggtatgtgcctctgcttt

SEQ ID NO: 1053 - DNA, 97 bp, Artificial Sequence; identical to SEQ ID NO: 657
  Synthetic: Hsa94F

SEQ ID NO: 1054 - DNA, 97 bp, Artificial Sequence
  Synthetic: Hsa96F
accgcaaacaccgcatctgggagaggaaagcagaaggagttccccgcgccagcggggataaaccgccctgttgatgcaggacactcgccgcaggctc

SEQ ID NO: 1055 - DNA, 97 bp, Artificial Sequence
  Synthetic: Hsa97F
accgccctgcccactactctcttaatgctgacaacagagttccccgcgccagcggggataaaccgcagaggtgggagcagtgcccattgctggaagc

SEQ ID NO: 1056 - DNA, 97 bp, Artificial Sequence
  Synthetic: Hsa98F
accgtgcttccagcaatgggcactgctcccacctctgagttccccgcgccagcggggataaaccgacgaggatgtccatcacataatccaaatggcc

SEQ ID NO: 1057 - DNA, 97 bp, Artificial Sequence
  Synthetic: Hsa99F
accgactgctcagggctatcctctcagagtgacattgagttccccgcgccagcggggataaaccgctgcttcaccttaaataacaaaaacagaggtt

SEQ ID NO: 1058 - DNA, 97 bp, Artificial Sequence
  Synthetic: Hsa100F
accggacaaagttggttcttcagaatcattctgtgagagttccccgcgccagcggggataaaccgttctagaaatgaaacatgttctaataatacag

SEQ ID NO: 1059 - DNA, 97 bp, Artificial Sequence
  Synthetic: Hsa101F
accgagctagttaaggacaaagttggttcttcagaagagttccccgcgccagcggggataaaccgaaacatgttctaataatacagtaatctctcag

SEQ ID NO: 1060 - DNA, 97 bp, Artificial Sequence
  Synthetic: Hsa103F
accgaaaacccaatagagtaggttctttgatcttttgagttccccgcgccagcggggataaaccggaatctttggacaaagtgaaaaacctttttga

SEQ ID NO: 1061 - DNA, 97 bp, Artificial Sequence
  Synthetic: Hsa104F
accgattcctttgcaattttaacttttttcccgctagagttccccgcgccagcggggataaaccgagcaaggtactagtgaaatcaccagttttagc

SEQ ID NO: 1062 - DNA, 97 bp, Artificial Sequence
  Synthetic: Hsa105F
accgttttgagattttcagtttgtctacataaattagagttccccgcgccagcggggataaaccgaaaatgtagaaaaagaaacagcaaaaagtcct

SEQ ID NO: 1063 - DNA, 97 bp, Artificial Sequence
  Synthetic: Hsa106F
accgtctgactcacagaagtttttctactacaacttgagttccccgcgccagcggggataaaccggaatatttgatggtcaaccagaaagaataaat

SEQ ID NO: 1064 - DNA, 97 bp, Artificial Sequence
  Synthetic: Hsa107F
accgcagatgaatttaccacattatatgaaaagcctgagttccccgcgccagcggggataaaccgtttccattttagaaagttccttacacaaagtt

SEQ ID NO: 1065 - DNA, 97 bp, Artificial Sequence
  Synthetic: Hsa108F
accgtttcagttttaccaatttccatttttacgtttgagttccccgcgccagcggggataaaccgtttgttctacttactccaaagattcagaaaac

SEQ ID NO: 1066 - DNA, 97 bp, Artificial Sequence
  Synthetic: Hsa109F
accgtgtggcatgacttggcagtttagaatctgtcagagttccccgcgccagcggggataaaccggttttgtcaaattcaagaattggaaaaagaag

SEQ ID NO: 1067 - DNA, 97 bp, Artificial Sequence
  Synthetic: Hsa112F
accgttatgcaattcttctggtttctgatcaaagaagagttccccgcgccagcggggataaaccgaaagaacaaaatggacattctaagttatgagg

SEQ ID NO: 1068 - DNA, 97 bp, Artificial Sequence
  Synthetic: Hsa120F
accggaatgatttccacagaggtgaggccaggggccgagttccccgcgccagcggggataaaccgccatggacttctatgatccagcaaggtaggtt

SEQ ID NO: 1069 - DNA, 97 bp, Artificial Sequence
  Synthetic: Hsa122F
accgaagaatcttctctgaacctacaagagaggaaagagttccccgcgccagcggggataaaccgagatgatgaggtgagttggcagcaggtctttg

SEQ ID NO: 1070 - DNA, 97 bp, Artificial Sequence
  Synthetic: Hsa123F
accgtgacgggctattaccgggtgaactacgacgaagagttccccgcgccagcggggataaaccgtgctgaagagatcgttctgggctgtggagagg

SEQ ID NO: 1071 - DNA, 97 bp, Artificial Sequence
  Synthetic: Hsa124F
accgtctaagtcatccaaagcatgaatcagggaggagagttccccgcgccagcggggataaaccgagctaatcctcaagtcggcgtggcttttcctc

SEQ ID NO: 1072 - DNA, 97 bp, Artificial Sequence
  Synthetic: Hsa126F
accgtcttagaccccagccacagggatatttccctggagttccccgcgccagcggggataaaccgttccttcgtcatccttgtaatccatcagggtc

SEQ ID NO: 1073 - DNA, 97 bp, Artificial Sequence
  Synthetic: Hsa128F
accggtaaatatgagggaaatgtctttctatgaagagagttccccgcgccagcggggataaaccgctgtgttctcatgtcaaaaacatggaactttc

SEQ ID NO: 1074 - DNA, 97 bp, Artificial Sequence
  Synthetic: Hsa33R
actcggcattaataggaggtcagtacatttttagtacggtttatccccgctggcgcggggaactcgccagagacatactgtgacgtgaggaaacgct

SEQ ID NO: 1075 - DNA, 97 bp, Artificial Sequence
  Synthetic: Hsa36R
actcgaaactccgccagacaagtctgtggctgtcgacggtttatccccgctggcgcggggaactcttctgggctggctaggttggcagcgaatgagg

SEQ ID NO: 1076 - DNA, 97 bp, Artificial Sequence
  Synthetic: Hsa37R
actcgaggagtccagctttgaacaaacttgagactacggtttatccccgctggcgcggggaactcaggccctcacttagcatgtcgacagccacaga

SEQ ID NO: 1077 - DNA, 97 bp, Artificial Sequence
  Synthetic: Hsa38R
actctatcagttctccagtggaggagtccttcctcccggtttatccccgctggcgcggggaactcgacaccagctgtgaagtcctcataacagccaa

SEQ ID NO: 1078 - DNA, 97 bp, Artificial Sequence
  Synthetic: Hsa39R
actcggcggtgggggaagacttaaccgagttgccgtcggtttatccccgctggcgcggggaactcgggagatgtagtcccgggccgacgcattacct

SEQ ID NO: 1079 - DNA, 97 bp, Artificial Sequence
  Synthetic: Hsa40R
actcatcttccacctacttcccttaccccgcctccccggtttatccccgctggcgcggggaactcaggtgggcagctagctgcagcgactaccgcat

SEQ ID NO: 1080 - DNA, 97 bp, Artificial Sequence
  Synthetic: Hsa42R
actctttggctactgaagacctgactgccttttcatcggtttatccccgctggcgcggggaactcttttcccccactctctctccacctcctcctgc

SEQ ID NO: 1081 - DNA, 97 bp, Artificial Sequence
  Synthetic: Hsa43R
actcatacatggtagatatatattttaaaaacttaccggtttatccccgctggcgcggggaactcggttttttgcactgaatgtaacctagactcat

SEQ ID NO: 1082 - DNA, 97 bp, Artificial Sequence
  Synthetic: Hsa44R
actcgcacaagtggatttccatcaccgaggccctagcggtttatccccgctggcgcggggaactcggcagaggttttaaatttggctccaaggaaag

SEQ ID NO: 1083 - DNA, 97 bp, Artificial Sequence
  Synthetic: Hsa45R
actcttcttaactggcattgtgggcaatggattggtcggtttatccccgctggcgcggggaactcctgacaggtgcagcctgtacttgtccgtcatg

SEQ ID NO: 1084 - DNA, 97 bp, Artificial Sequence
  Synthetic: Hsa46R
actcgaagtacctggtcttagcatctggacagacctcggtttatccccgctggcgcggggaactcaactgaggcctgcgctgagacccaaaacttgt

SEQ ID NO: 1085 - DNA, 97 bp, Artificial Sequence
  Synthetic: Hsa47R
actcccggacccccagcatcccccaaccccttcgtgcggtttatccccgctggcgcggggaactcggtccttccgacgcccgctccccacacattac

SEQ ID NO: 1086 - DNA, 97 bp, Artificial Sequence
  Synthetic: Hsa48R
actcaccaccaccacacggtccatacaactggccttcggtttatccccgctggcgcggggaactcgggacccggttctgggtcaccctcagccgccg

SEQ ID NO: 1087 - DNA, 97 bp, Artificial Sequence
  Synthetic: Hsa49R
actcgctggctctattcacaccagtttgtgatttgtcggtttatccccgctggcgcggggaactcttccctcttgatttattaaatttgcagatata

SEQ ID NO: 1088 - DNA, 97 bp, Artificial Sequence
  Synthetic: Hsa51R
actcgctcgggagcctcttgctggaaaatagaacagcggtttatccccgctggcgcggggaactcggggagaagttcagaaactacctcttagtctt

SEQ ID NO: 1089 - DNA, 97 bp, Artificial Sequence
  Synthetic: Hsa52R
actcacggctaagtttgttttgctctcctgcagacacggtttatccccgctggcgcggggaactccgacttctttccaggttgcttggtcttcagtc

SEQ ID NO: 1090 - DNA, 97 bp, Artificial Sequence
  Synthetic: Hsa53R
actcttataaagttatataaaatttgtcaatacctgcggtttatccccgctggcgcggggaactcaaaaatgcctattggatccaaagagaggccaa

SEQ ID NO: 1091 - DNA, 97 bp, Artificial Sequence
  Synthetic: Hsa56R
actctactgctaccccagagttacctacccagggaacggtttatccccgctggcgcggggaactcggtacttccaagggtactaggtgttgtagttt

SEQ ID NO: 1092 - DNA, 97 bp, Artificial Sequence
  Synthetic: Hsa58R
actccccaggagagaatccgagatttctgttaaggccggtttatccccgctggcgcggggaactccctggaggagtaccttgtctcccatgccatcc

SEQ ID NO: 1093 - DNA, 97 bp, Artificial Sequence
  Synthetic: Hsa59R
actcactacaattaaaagtcacagtcttgataccttcggtttatccccgctggcgcggggaactcatcttcgacaagagctagaagataattccaat

SEQ ID NO: 1094 - DNA, 97 bp, Artificial Sequence
  Synthetic: Hsa60R
actctaaactacaattaaaagtcacagtcttgataccggtttatccccgctggcgcggggaactcttcgacaagagctagaagataattccaatcat

SEQ ID NO: 1095 - DNA, 97 bp, Artificial Sequence
  Synthetic: Hsa62R
actctacctttcagtaatttactgaccttggaactgcggtttatccccgctggcgcggggaactcgtttctgcagagttttgcacaaaatctgttcc

SEQ ID NO: 1096 - DNA, 97 bp, Artificial Sequence
  Synthetic: Hsa63R
actcgcttcactaattcccttaatatttattagctccggtttatccccgctggcgcggggaactcacgatgtgaagaaattggaagaagctggattc

SEQ ID NO: 1097 - DNA, 97 bp, Artificial Sequence
  Synthetic: Hsa67R
actccagccaagcgggcagaagaggaattgctccttcggtttatccccgctggcgcggggaactcgaggcgcctgtgcgggggtgccgggcctctgg

SEQ ID NO: 1098 - DNA, 97 bp, Artificial Sequence
  Synthetic: Hsa68R
actccttttgtgcagtccatagcattgacatcagctcggtttatccccgctggcgcggggaactcgaattcaaagaagctgcaaagagcgacccttc

SEQ ID NO: 1099 - DNA, 97 bp, Artificial Sequence
  Synthetic: Hsa69R
actcaaaaaaaatctagcagtcgctggcttaccttgcggtttatccccgctggcgcggggaactcaagagttgtctacagacatagaggattttgtt

SEQ ID NO: 1100 - DNA, 97 bp, Artificial Sequence
  Synthetic: Hsa72R
actcggacacctggccgccagtcgcctgggcctggccggtttatccccgctggcgcggggaactctgccccgaggcggcaccccccagtgccactgg

SEQ ID NO: 1101 - DNA, 97 bp, Artificial Sequence
  Synthetic: Hsa74R
actcattttgcaaaaaaggaaaataactctcctgaacggtttatccccgctggcgcggggaactctgtagaagtcttttggcacggtttctgtagcc

SEQ ID NO: 1102 - DNA, 97 bp, Artificial Sequence
  Synthetic: Hsa77R
actcaaacattgaataagtccatcagacagaggaaccggtttatccccgctggcgcggggaactcatggtcttgttgttaaattcctttaggaaatc

SEQ ID NO: 1103 - DNA, 97 bp, Artificial Sequence
  Synthetic: Hsa78R
actctgaaatatttgagacttccatgttactgatttcggtttatccccgctggcgcggggaactccatcacttcgtagtagagaacgtttccaccgt

SEQ ID NO: 1104 - DNA, 97 bp, Artificial Sequence
  Synthetic: Hsa82R
actcaaaagaaataaattgatatttacctggtggcacggtttatccccgctggcgcggggaactctaaaaatgcgtctgtttccatatctcataatt

SEQ ID NO: 1105 - DNA, 97 bp, Artificial Sequence
  Synthetic: Hsa84R
actctaagcaataaactgtttctttttgtatatcttcggtttatccccgctggcgcggggaactcatgtaagattctacaggagagagttaaaaaga

SEQ ID NO: 1106 - DNA, 97 bp, Artificial Sequence
  Synthetic: Hsa87R
actcgcagtctgtatgagattcaagatgctgctcttcggtttatccccgctggcgcggggaactcacgtatttctagcctaccaaaatcagagaagc

SEQ ID NO: 1107 - DNA, 97 bp, Artificial Sequence
  Synthetic: Hsa88R
actcgaagccactggagaagttccagatattgcctgcggtttatccccgctggcgcggggaactccagtggtaaataagagagatgaagagcagcat

SEQ ID NO: 1108 - DNA, 97 bp, Artificial Sequence
  Synthetic: Hsa89R
actctaggacatttggcattgactttccaatgtggtcggtttatccccgctggcgcggggaactctctgttttatactttaacaggatttggaaaaa

SEQ ID NO: 1109 - DNA, 97 bp, Artificial Sequence
  Synthetic: Hsa92R
actcaaagcagaggcacataccaggcagtcagagtgcggtttatccccgctggcgcggggaactcgctgcaaggggccactgcccactgactgctgc

SEQ ID NO: 1110 - DNA, 97 bp, Artificial Sequence; identical to SEQ ID NO: 753
  Synthetic: Hsa94R

SEQ ID NO: 1111 - DNA, 97 bp, Artificial Sequence
  Synthetic: Hsa96R
actcgagcctgcggcgagtgtcctgcatcaacagggcggtttatccccgctggcgcggggaactccttctgctttcctctcccagatgcggtgtttg

SEQ ID NO: 1112 - DNA, 97 bp, Artificial Sequence
  Synthetic: Hsa97R
actcgcttccagcaatgggcactgctcccacctctgcggtttatccccgctggcgcggggaactctgttgtcagcattaagagagtagtgggcaggg

SEQ ID NO: 1113 - DNA, 97 bp, Artificial Sequence
  Synthetic: Hsa98R
actcggccatttggattatgtgatggacatcctcgtcggtttatccccgctggcgcggggaactcagaggtgggagcagtgcccattgctggaagca

SEQ ID NO: 1114 - DNA, 97 bp, Artificial Sequence
  Synthetic: Hsa99R
actcaacctctgtttttgttatttaaggtgaagcagcggtttatccccgctggcgcggggaactcaatgtcactctgagaggatagccctgagcagt

SEQ ID NO: 1115 - DNA, 97 bp, Artificial Sequence
  Synthetic: Hsa100R
actcctgtattattagaacatgtttcatttctagaacggtttatccccgctggcgcggggaactctcacagaatgattctgaagaaccaactttgtc

SEQ ID NO: 1116 - DNA, 97 bp, Artificial Sequence
  Synthetic: Hsa101R
actcctgagagattactgtattattagaacatgtttcggtttatccccgctggcgcggggaactcttctgaagaaccaactttgtccttaactagct

SEQ ID NO: 1117 - DNA, 97 bp, Artificial Sequence
  Synthetic: Hsa103R
actctcaaaaaggtttttcactttgtccaaagattccggtttatccccgctggcgcggggaactcaaaagatcaaagaacctactctattgggtttt

SEQ ID NO: 1118 - DNA, 97 bp, Artificial Sequence
  Synthetic: Hsa104R
actcgctaaaactggtgatttcactagtaccttgctcggtttatccccgctggcgcggggaactctagcgggaaaaaagttaaaattgcaaaggaat

SEQ ID NO: 1119 - DNA, 97 bp, Artificial Sequence
  Synthetic: Hsa105R
actcaggactttttgctgtttctttttctacattttcggtttatccccgctggcgcggggaactctaatttatgtagacaaactgaaaatctcaaaa

SEQ ID NO: 1120 - DNA, 97 bp, Artificial Sequence
  Synthetic: Hsa106R
actcatttattctttctggttgaccatcaaatattccggtttatccccgctggcgcggggaactcaagttgtagtagaaaaacttctgtgagtcaga

SEQ ID NO: 1121 - DNA, 97 bp, Artificial Sequence
  Synthetic: Hsa107R
actcaactttgtgtaaggaactttctaaaatggaaacggtttatccccgctggcgcggggaactcaggcttttcatataatgtggtaaattcatctg

SEQ ID NO: 1122 - DNA, 97 bp, Artificial Sequence
  Synthetic: Hsa108R
actcgttttctgaatctttggagtaagtagaacaaacggtttatccccgctggcgcggggaactcaaacgtaaaaatggaaattggtaaaactgaaa

SEQ ID NO: 1123 - DNA, 97 bp, Artificial Sequence
  Synthetic: Hsa109R
actccttctttttccaattcttgaatttgacaaaaccggtttatccccgctggcgcggggaactctgacagattctaaactgccaagtcatgccaca

SEQ ID NO: 1124 - DNA, 97 bp, Artificial Sequence
  Synthetic: Hsa112R
actccctcataacttagaatgtccattttgttctttcggtttatccccgctggcgcggggaactcttctttgatcagaaaccagaagaattgcataa

SEQ ID NO: 1125 - DNA, 97 bp, Artificial Sequence
  Synthetic: Hsa120R
actcaacctaccttgctggatcatagaagtccatggcggtttatccccgctggcgcggggaactcggcccctggcctcacctctgtggaaatcattc

SEQ ID NO: 1126 - DNA, 97 bp, Artificial Sequence
  Synthetic: Hsa122R
actccaaagacctgctgccaactcacctcatcatctcggtttatccccgctggcgcggggaactctttcctctcttgtaggttcagagaagattctt

SEQ ID NO: 1127 - DNA, 97 bp, Artificial Sequence
  Synthetic: Hsa123R
actccctctccacagcccagaacgatctcttcagcacggtttatccccgctggcgcggggaactcttcgtcgtagttcacccggtaatagcccgtca

SEQ ID NO: 1128 - DNA, 97 bp, Artificial Sequence
  Synthetic: Hsa124R
actcgaggaaaagccacgccgacttgaggattagctcggtttatccccgctggcgcggggaactctcctccctgattcatgctttggatgacttaga

SEQ ID NO: 1129 - DNA, 97 bp, Artificial Sequence
  Synthetic: Hsa126R
actcgaccctgatggattacaaggatgacgaaggaacggtttatccccgctggcgcggggaactccagggaaatatccctgtggctggggtctaaga

SEQ ID NO: 1130 - DNA, 97 bp, Artificial Sequence
  Synthetic: Hsa128R
actcgaaagttccatgtttttgacatgagaacacagcggtttatccccgctggcgcggggaactctcttcatagaaagacatttccctcatatttac

SEQ ID NO: 1131 - DNA, 51 bp, Artificial Sequence
  Synthetic: Hsa33F_ilmn (Illumina)
cactctttccctacacgacgctcttccgatctccagtcatgaacgtctccg

SEQ ID NO: 1132 - DNA, 50 bp, Artificial Sequence
  Synthetic: Hsa36F_ilmn (Illumina)
cactctttccctacacgacgctcttccgatctgaagagccctgccgagag

SEQ ID NO: 1133 - DNA, 52 bp, Artificial Sequence
  Synthetic: Hsa37F_ilmn (Illumina)
cactctttccctacacgacgctcttccgatctctaggttggcagcgaatgag

SEQ ID NO: 1134 - DNA, 52 bp, Artificial Sequence
  Synthetic: Hsa38F_ilmn (Illumina)
cactctttccctacacgacgctcttccgatctcagcctatgagcttcctggt

SEQ ID NO: 1135 - DNA, 52 bp, Artificial Sequence
  Synthetic: Hsa39F_ilmn (Illumina)
cactctttccctacacgacgctcttccgatctaatagtccagctgcgatggt

SEQ ID NO: 1136 - DNA, 52 bp, Artificial Sequence
  Synthetic: Hsa40F_ilmn (Illumina)
cactctttccctacacgacgctcttccgatctcgcaagtttccttctctgga

SEQ ID NO: 1137 - DNA, 50 bp, Artificial Sequence
  Synthetic: Hsa42F_ilmn (Illumina)
cactctttccctacacgacgctcttccgatctcttcagcactgcagccac

SEQ ID NO: 1138 - DNA, 52 bp, Artificial Sequence
  Synthetic: Hsa43F_ilmn (Illumina)
cactctttccctacacgacgctcttccgatctccactgtttcatgtggcatc

SEQ ID NO: 1139 - DNA, 52 bp, Artificial Sequence
  Synthetic: Hsa44F_ilmn (Illumina)
cactctttccctacacgacgctcttccgatctgatgaatgtccacctcgctt

SEQ ID NO: 1140 - DNA, 52 bp, Artificial Sequence
  Synthetic: Hsa45F_ilmn (Illumina)
cactctttccctacacgacgctcttccgatcttcccaaagtaccagtttgcc

SEQ ID NO: 1141 - DNA, 52 bp, Artificial Sequence
  Synthetic: Hsa46F_ilmn (Illumina)
cactctttccctacacgacgctcttccgatcttttggacacacgaaggcata

SEQ ID NO: 1142 - DNA, 52 bp, Artificial Sequence
  Synthetic: Hsa47F_ilmn (Illumina)
cactctttccctacacgacgctcttccgatctctcagccatctccttctcgt

SEQ ID NO: 1143 - DNA, 51 bp, Artificial Sequence
  Synthetic: Hsa48F_ilmn (Illumina)
cactctttccctacacgacgctcttccgatctagtgccgctatggggacct

SEQ ID NO: 1144 - DNA, 59 bp, Artificial Sequence
  Synthetic: Hsa49F_ilmn (Illumina)
cactctttccctacacgacgctcttccgatctcacctttattcctttgtctaacaatct

SEQ ID NO: 1145 - DNA, 52 bp, Artificial Sequence
  Synthetic: Hsa51F_ilmn (Illumina)
cactctttccctacacgacgctcttccgatctagactcttgggatgacgcac

SEQ ID NO: 1146 - DNA, 52 bp, Artificial Sequence
  Synthetic: Hsa52F_ilmn (Illumina)
cactctttccctacacgacgctcttccgatctcaagctctggtaggcagctc

SEQ ID NO: 1147 - DNA, 53 bp, Artificial Sequence
  Synthetic: Hsa53F_ilmn (Illumina)
cactctttccctacacgacgctcttccgatctaatgcatccctgtgtaagtgc

SEQ ID NO: 1148 - DNA, 52 bp, Artificial Sequence
  Synthetic: Hsa56F_ilmn (Illumina)
cactctttccctacacgacgctcttccgatctccatgttgagacacagggtg

SEQ ID NO: 1149 - DNA, 52 bp, Artificial Sequence
  Synthetic: Hsa58F_ilmn (Illumina)
cactctttccctacacgacgctcttccgatctaggtctctctggtgctggaa

SEQ ID NO: 1150 - DNA, 52 bp, Artificial Sequence
  Synthetic: Hsa59F_ilmn (Illumina)
cactctttccctacacgacgctcttccgatcttgaggcactgaagatggaga

SEQ ID NO: 1151 - DNA, 52 bp, Artificial Sequence; identical to SEQ ID NO: 1150
  Synthetic: Hsa60F_ilmn (Illumina)

SEQ ID NO: 1152 - DNA, 55 bp, Artificial Sequence
  Synthetic: Hsa62F_ilmn (Illumina)
cactctttccctacacgacgctcttccgatcttttgccctgaattccttacatac

SEQ ID NO: 1153 - DNA, 52 bp, Artificial Sequence
  Synthetic: Hsa63F_ilmn (Illumina)
cactctttccctacacgacgctcttccgatctcttcatttgcagcagtgtgg

SEQ ID NO: 1154 - DNA, 52 bp, Artificial Sequence
  Synthetic: Hsa67F_ilmn (Illumina)
cactctttccctacacgacgctcttccgatctcccaactcacctcatcacct

SEQ ID NO: 1155 - DNA, 52 bp, Artificial Sequence
  Synthetic: Hsa68F_ilmn (Illumina)
cactctttccctacacgacgctcttccgatctaaatgaatgaggatggcctg

SEQ ID NO: 1156 - DNA, 52 bp, Artificial Sequence
  Synthetic: Hsa69F_ilmn (Illumina)
cactctttccctacacgacgctcttccgatctggcttgctttcagtttggag

SEQ ID NO: 1157 - DNA, 52 bp, Artificial Sequence
  Synthetic: Hsa72F_ilmn (Illumina)
cactctttccctacacgacgctcttccgatctcctgacttgggtacgtgctt

SEQ ID NO: 1158 - DNA, 52 bp, Artificial Sequence
  Synthetic: Hsa74F_ilmn (Illumina)
cactctttccctacacgacgctcttccgatctcaaggaaggattttcgggtt

SEQ ID NO: 1159 - DNA, 50 bp, Artificial Sequence
  Synthetic: Hsa77F_ilmn (Illumina)
cactctttccctacacgacgctcttccgatcttcaggtcatgcgtggaca

SEQ ID NO: 1160 - DNA, 52 bp, Artificial Sequence
  Synthetic: Hsa78F_ilmn (Illumina)
cactctttccctacacgacgctcttccgatctcatacgctatgtgacacggg

SEQ ID NO: 1161 - DNA, 52 bp, Artificial Sequence
  Synthetic: Hsa82F_ilmn (Illumina)
cactctttccctacacgacgctcttccgatctgcacaaacaatgaggtgcat

SEQ ID NO: 1162 - DNA, 56 bp, Artificial Sequence
  Synthetic: Hsa84F_ilmn (Illumina)
cactctttccctacacgacgctcttccgatctcaattggaatcctaactttccttg

SEQ ID NO: 1163 - DNA, 54 bp, Artificial Sequence
  Synthetic: Hsa87F_ilmn (Illumina)
cactctttccctacacgacgctcttccgatcttgcatatttcttcatgtgacca

SEQ ID NO: 1164 - DNA, 54 bp, Artificial Sequence
  Synthetic: Hsa88F_ilmn (Illumina)
cactctttccctacacgacgctcttccgatctctttgccacgtatttctagcct

SEQ ID NO: 1165 - DNA, 60 bp, Artificial Sequence
  Synthetic: Hsa89F_ilmn (Illumina)
cactctttccctacacgacgctcttccgatctttctatgagaaaggttgtgagaataata

SEQ ID NO: 1166 - DNA, 51 bp, Artificial Sequence
  Synthetic: Hsa92F_ilmn (Illumina)
cactctttccctacacgacgctcttccgatctagtgacgcgcactgtctgt

SEQ ID NO: 1167 - DNA, 50 bp, Artificial Sequence; identical to SEQ ID NO: 825
  Synthetic: Hsa94F_ilmn (Illumina)

SEQ ID NO: 1168 - DNA, 53 bp, Artificial Sequence
  Synthetic: Hsa96F_ilmn (Illumina)
cactctttccctacacgacgctcttccgatctccagtggataatgaatgcaca

SEQ ID NO: 1169 - DNA, 52 bp, Artificial Sequence
  Synthetic: Hsa97F_ilmn (Illumina)
cactctttccctacacgacgctcttccgatcttagcttgctttggagggaaa

SEQ ID NO: 1170 - DNA, 52 bp, Artificial Sequence
  Synthetic: Hsa98F_ilmn (Illumina)
cactctttccctacacgacgctcttccgatctaagagagtagtgggcagggc

SEQ ID NO: 1171 - DNA, 52 bp, Artificial Sequence
  Synthetic: Hsa99F_ilmn (Illumina)
cactctttccctacacgacgctcttccgatctaatgcaaaggacaccacaca

SEQ ID NO: 1172 - DNA, 56 bp, Artificial Sequence
  Synthetic: Hsa100F_ilmn (Illumina)
cactctttccctacacgacgctcttccgatctggtttattgcattcttctgtgaaa

SEQ ID NO: 1173 - DNA, 56 bp, Artificial Sequence; identical to SEQ ID NO: 1172
  Synthetic: Hsa101F_ilmn (Illumina)

SEQ ID NO: 1174 - DNA, 52 bp, Artificial Sequence
  Synthetic: Hsa103F_ilmn (Illumina)
cactctttccctacacgacgctcttccgatctagtgaccttccagggacaac

SEQ ID NO: 1175 - DNA, 52 bp, Artificial Sequence; identical to SEQ ID NO: 1174
  Synthetic: Hsa104F_ilmn (Illumina)

SEQ ID NO: 1176 - DNA, 52 bp, Artificial Sequence
  Synthetic: Hsa105F_ilmn (Illumina)
cactctttccctacacgacgctcttccgatcttgtggtgccacctaagctct

SEQ ID NO: 1177 - DNA, 54 bp, Artificial Sequence
  Synthetic: Hsa106F_ilmn (Illumina)
cactctttccctacacgacgctcttccgatctttcagtcattgaaaattcagcc

SEQ ID NO: 1178 - DNA, 52 bp, Artificial Sequence
  Synthetic: Hsa107F_ilmn (Illumina)
cactctttccctacacgacgctcttccgatctcgaacattcagaccagctca

SEQ ID NO: 1179 - DNA, 57 bp, Artificial Sequence
  Synthetic: Hsa108F_ilmn (Illumina)
cactctttccctacacgacgctcttccgatctagtgtcacttgttgagaacattcat

SEQ ID NO: 1180 - DNA, 57 bp, Artificial Sequence
  Synthetic: Hsa109F_ilmn (Illumina)
cactctttccctacacgacgctcttccgatcttttgaaacagaagcagtagaaattg

SEQ ID NO: 1181 - DNA, 56 bp, Artificial Sequence
  Synthetic: Hsa112F_ilmn (Illumina)
cactctttccctacacgacgctcttccgatctttagtgtcgccaaagagtcattta

SEQ ID NO: 1182 - DNA, 52 bp, Artificial Sequence
  Synthetic: Hsa120F_ilmn (Illumina)
cactctttccctacacgacgctcttccgatctcccatcctgaaaccaagaag

SEQ ID NO: 1183 - DNA, 52 bp, Artificial Sequence
  Synthetic: Hsa122F_ilmn (Illumina)
cactctttccctacacgacgctcttccgatcttggaatttcttggcaatgtg

SEQ ID NO: 1184 - DNA, 51 bp, Artificial Sequence
  Synthetic: Hsa123F_ilmn (Illumina)
cactctttccctacacgacgctcttccgatctcaccgagtggtctctctgc

SEQ ID NO: 1185 - DNA, 53 bp, Artificial Sequence
  Synthetic: Hsa124F_ilmn (Illumina)
cactctttccctacacgacgctcttccgatcttccatctttcttaccaggcag

SEQ ID NO: 1186 - DNA, 52 bp, Artificial Sequence
  Synthetic: Hsa126F_ilmn (Illumina)
cactctttccctacacgacgctcttccgatctcaagggttcttctcaaccca

SEQ ID NO: 1187 - DNA, 52 bp, Artificial Sequence
  Synthetic: Hsa128F_ilmn (Illumina)
cactctttccctacacgacgctcttccgatctcctggaagaaaccttggtga

SEQ ID NO: 1188 - DNA, 48 bp, Artificial Sequence
  Synthetic: Hsa33R_ilmn (Illumina)
ggagttcagacgtgtgctcttccgatctaaggcccagaattcagcata

SEQ ID NO: 1189 - DNA, 48 bp, Artificial Sequence
  Synthetic: Hsa36R_ilmn (Illumina)
ggagttcagacgtgtgctcttccgatctacttaagtgggcaccaggag

SEQ ID NO: 1190 - DNA, 48 bp, Artificial Sequence
  Synthetic: Hsa37R_ilmn (Illumina)
ggagttcagacgtgtgctcttccgatctgacaaatctccagctgctcc

SEQ ID NO: 1191 - DNA, 48 bp, Artificial Sequence
  Synthetic: Hsa38R_ilmn (Illumina)
ggagttcagacgtgtgctcttccgatctatagcagtttccatggtgcc

SEQ ID NO: 1192 - DNA, 48 bp, Artificial Sequence
  Synthetic: Hsa39R_ilmn (Illumina)
ggagttcagacgtgtgctcttccgatctgcgagagtatcgtctgagcc

SEQ ID NO: 1193 - DNA, 48 bp, Artificial Sequence
  Synthetic: Hsa40R_ilmn (Illumina)
ggagttcagacgtgtgctcttccgatctttctggaaagctcctcggta

SEQ ID NO: 1194 - DNA, 50 bp, Artificial Sequence
  Synthetic: Hsa42R_ilmn (Illumina)
ggagttcagacgtgtgctcttccgatcttgtccactgaagtaggtgcaaa

SEQ ID NO: 1195 - DNA, 48 bp, Artificial Sequence
  Synthetic: Hsa43R_ilmn (Illumina)
ggagttcagacgtgtgctcttccgatctttggtaaaagggcaacaatg

SEQ ID NO: 1196 - DNA, 48 bp, Artificial Sequence
  Synthetic: Hsa44R_ilmn (Illumina)
ggagttcagacgtgtgctcttccgatctattgggatcagcatcgactc

SEQ ID NO: 1197 - DNA, 48 bp, Artificial Sequence
  Synthetic: Hsa45R_ilmn (Illumina)
ggagttcagacgtgtgctcttccgatctctgcccaccatctactccat

SEQ ID NO: 1198 - DNA, 48 bp, Artificial Sequence
  Synthetic: Hsa46R_ilmn (Illumina)
ggagttcagacgtgtgctcttccgatctctaactgccctggagacctg

SEQ ID NO: 1199 - DNA, 46 bp, Artificial Sequence
  Synthetic: Hsa47R_ilmn (Illumina)
ggagttcagacgtgtgctcttccgatctctccctcccaccttctcc

SEQ ID NO: 1200 - DNA, 47 bp, Artificial Sequence
  Synthetic: Hsa48R_ilmn (Illumina)
ggagttcagacgtgtgctcttccgatctgtagccgtagggggctaca

SEQ ID NO: 1201 - DNA, 47 bp, Artificial Sequence
  Synthetic: Hsa49R_ilmn (Illumina)
ggagttcagacgtgtgctcttccgatctgaccctgccacttacatgc

SEQ ID NO: 1202 - DNA, 48 bp, Artificial Sequence
  Synthetic: Hsa51R_ilmn (Illumina)
ggagttcagacgtgtgctcttccgatctcaactctgactgggtcacca

SEQ ID NO: 1203 - DNA, 48 bp, Artificial Sequence
  Synthetic: Hsa52R_ilmn (Illumina)
ggagttcagacgtgtgctcttccgatcttgcttcccaagagtttgctt

SEQ ID NO: 1204 - DNA, 50 bp, Artificial Sequence
  Synthetic: Hsa53R_ilmn (Illumina)
ggagttcagacgtgtgctcttccgatctggttctaagcaacactgtgacg

SEQ ID NO: 1205 - DNA, 48 bp, Artificial Sequence
  Synthetic: Hsa56R_ilmn (Illumina)
ggagttcagacgtgtgctcttccgatctttcttcctcctcgtttccct

SEQ ID NO: 1206 - DNA, 48 bp, Artificial Sequence
  Synthetic: Hsa58R_ilmn (Illumina)
ggagttcagacgtgtgctcttccgatctgcttagccacctcagcaatc

SEQ ID NO: 1207 - DNA, 54 bp, Artificial Sequence
  Synthetic: Hsa59R_ilmn (Illumina)
ggagttcagacgtgtgctcttccgatcttcaagtttacaagagggaatactgaa

SEQ ID NO: 1208 - DNA, 54 bp, Artificial Sequence; identical to SEQ ID NO: 1207
  Synthetic: Hsa60R_ilmn (Illumina)

SEQ ID NO: 1209 - DNA, 49 bp, Artificial Sequence
  Synthetic: Hsa62R_ilmn (Illumina)
ggagttcagacgtgtgctcttccgatctccattctactcatccacagcc

SEQ ID NO: 1210 - DNA, 48 bp, Artificial Sequence
  Synthetic: Hsa63R_ilmn (Illumina)
ggagttcagacgtgtgctcttccgatctattcccactaatgcctccct

SEQ ID NO: 1211 - DNA, 48 bp, Artificial Sequence
  Synthetic: Hsa67R_ilmn (Illumina)
ggagttcagacgtgtgctcttccgatcttgagtcctacctcgtgcctc

SEQ ID NO: 1212 - DNA, 48 bp, Artificial Sequence
  Synthetic: Hsa68R_ilmn (Illumina)
ggagttcagacgtgtgctcttccgatctgctgcagactgaatggaaca

SEQ ID NO: 1213 - DNA, 48 bp, Artificial Sequence
  Synthetic: Hsa69R_ilmn (Illumina)
ggagttcagacgtgtgctcttccgatcttctagcctgggcaacagagt

SEQ ID NO: 1214 - DNA, 48 bp, Artificial Sequence
  Synthetic: Hsa72R_ilmn (Illumina)
ggagttcagacgtgtgctcttccgatctcacgaggagaaccctgagag

SEQ ID NO: 1215 - DNA, 50 bp, Artificial Sequence
  Synthetic: Hsa74R_ilmn (Illumina)
ggagttcagacgtgtgctcttccgatctgggtttctcttggtttctttga

SEQ ID NO: 1216 - DNA, 48 bp, Artificial Sequence
  Synthetic: Hsa77R_ilmn (Illumina)
ggagttcagacgtgtgctcttccgatctttggcaacatgtggattcat

SEQ ID NO: 1217 - DNA, 49 bp, Artificial Sequence
  Synthetic: Hsa78R_ilmn (Illumina)
ggagttcagacgtgtgctcttccgatcttggctaccttggaaactttga

SEQ ID NO: 1218 - DNA, 48 bp, Artificial Sequence
  Synthetic: Hsa82R_ilmn (Illumina)
ggagttcagacgtgtgctcttccgatctagccctgttctctcaccaga

SEQ ID NO: 1219 - DNA, 54 bp, Artificial Sequence
  Synthetic: Hsa84R_ilmn (Illumina)
ggagttcagacgtgtgctcttccgatctaaacttcagtttcatcatcatcattt

SEQ ID NO: 1220 - DNA, 48 bp, Artificial Sequence
  Synthetic: Hsa87R_ilmn (Illumina)
ggagttcagacgtgtgctcttccgatctttgcctgctttactgcaaga

SEQ ID NO: 1221 - DNA, 52 bp, Artificial Sequence
  Synthetic: Hsa88R_ilmn (Illumina)
ggagttcagacgtgtgctcttccgatctttgcattgaaagtctctttaggtg

SEQ ID NO: 1222 - DNA, 56 bp, Artificial Sequence
  Synthetic: Hsa89R_ilmn (Illumina)
ggagttcagacgtgtgctcttccgatcttcttcttcagaggtatctacaactgttt

SEQ ID NO: 1223 - DNA, 48 bp, Artificial Sequence
  Synthetic: Hsa92R_ilmn (Illumina)
ggagttcagacgtgtgctcttccgatcttggctttcactgtgctgttt

SEQ ID NO: 1224 - DNA, 48 bp, Artificial Sequence; identical to SEQ ID NO: 921
  Synthetic: Hsa94R_ilmn (Illumina)

SEQ ID NO: 1225 - DNA, 48 bp, Artificial Sequence
  Synthetic: Hsa96R_ilmn (Illumina)
ggagttcagacgtgtgctcttccgatcttgtagtaggaggaccgggtg

SEQ ID NO: 1226 - DNA, 48 bp, Artificial Sequence
  Synthetic: Hsa97R_ilmn (Illumina)
ggagttcagacgtgtgctcttccgatctctcgacagtcagggtggaat

SEQ ID NO: 1227 - DNA, 48 bp, Artificial Sequence
  Synthetic: Hsa98R_ilmn (Illumina)
ggagttcagacgtgtgctcttccgatcttctactggacggactggagc

SEQ ID NO: 1228 - DNA, 48 bp, Artificial Sequence
  Synthetic: Hsa99R_ilmn (Illumina)
ggagttcagacgtgtgctcttccgatctaatccagtcctgccaatgag

SEQ ID NO: 1229 - DNA, 49 bp, Artificial Sequence
  Synthetic: Hsa100R_ilmn (Illumina)
ggagttcagacgtgtgctcttccgatctggcatgacagagaatcagctt

SEQ ID NO: 1230 - DNA, 49 bp, Artificial Sequence; identical to SEQ ID NO: 1229
  Synthetic: Hsa101R_ilmn (Illumina)

SEQ ID NO: 1231 - DNA, 48 bp, Artificial Sequence
  Synthetic: Hsa103R_ilmn (Illumina)
ggagttcagacgtgtgctcttccgatcttttagggtctttgcccattg

SEQ ID NO: 1232 - DNA, 48 bp, Artificial Sequence; identical to SEQ ID NO: 1231
  Synthetic: Hsa104R_ilmn (Illumina)

SEQ ID NO: 1233 - DNA, 54 bp, Artificial Sequence
  Synthetic: Hsa105R_ilmn (Illumina)
ggagttcagacgtgtgctcttccgatcttcaagtaatgaagtctgactcacaga

SEQ ID NO: 1234 - DNA, 56 bp, Artificial Sequence
  Synthetic: Hsa106R_ilmn (Illumina)
ggagttcagacgtgtgctcttccgatcttgtcattttcagctatagtactgtttga

SEQ ID NO: 1235 - DNA, 53 bp, Artificial Sequence
  Synthetic: Hsa107R_ilmn (Illumina)
ggagttcagacgtgtgctcttccgatctaatcaaattcctctaacactccctt

SEQ ID NO: 1236 - DNA, 48 bp, Artificial Sequence
  Synthetic: Hsa108R_ilmn (Illumina)
ggagttcagacgtgtgctcttccgatctgaatgtgtggcatgacttgg

SEQ ID NO: 1237 - DNA, 48 bp, Artificial Sequence
  Synthetic: Hsa109R_ilmn (Illumina)
ggagttcagacgtgtgctcttccgatctttggcaacacgaaaggtaaa

SEQ ID NO: 1238 - DNA, 48 bp, Artificial Sequence
  Synthetic: Hsa112R_ilmn (Illumina)
ggagttcagacgtgtgctcttccgatctgttgtccctggaaggtcact

SEQ ID NO: 1239 - DNA, 48 bp, Artificial Sequence
  Synthetic: Hsa120R_ilmn (Illumina)
ggagttcagacgtgtgctcttccgatctcccaaattctgcctcatcat

SEQ ID NO: 1240 - DNA, 51 bp, Artificial Sequence
  Synthetic: Hsa122R_ilmn (Illumina)
ggagttcagacgtgtgctcttccgatctcccaaacaacttgctttcataga

SEQ ID NO: 1241 - DNA, 47 bp, Artificial Sequence
  Synthetic: Hsa123R_ilmn (Illumina)
ggagttcagacgtgtgctcttccgatctagcttgagggtgaggtggt

SEQ ID NO: 1242 - DNA, 52 bp, Artificial Sequence
  Synthetic: Hsa124R_ilmn (Illumina)
ggagttcagacgtgtgctcttccgatctcattaacagctgagaaacactgct

SEQ ID NO: 1243 - DNA, 48 bp, Artificial Sequence
  Synthetic: Hsa126R_ilmn (Illumina)
ggagttcagacgtgtgctcttccgatctgagaggcacgagaacacaca

SEQ ID NO: 1244 - DNA, 50 bp, Artificial Sequence
  Synthetic: Hsa128R_ilmn (Illumina)
ggagttcagacgtgtgctcttccgatctcaggtgtgtagcttggagtttg

SEQ ID NO: 1245 - DNA, 5610 bp, Oceanicola sp. HL-35
atgggccccaagaagaagagaaaggtaggctccggcatgaccacatttctgcagttccacgtgctgaccacatatcccccttctaaccctaatagggacgatcagggccggccaaagcaggcaaacctgggaggagcaccaaggctgcggctgagctcccagtctatcaagagggcaatgagggagagccctgcattccagcagggcctggatggacacatcggcacacggaccaagagactgggcgaggagatcagggaggagctggcaaagagggagggcgtgagcaccgatcaggccctggacgtggcatctaaggtggcagccatcttcagcaagctggaggcccccggcaaggacaaggtgcagaagcctctgaccacaaccctggcctttgtgagcccagatgagtgggcactggcaagagacctggcatccaggatgctggcaggagaggagatgcccaaggataaggagctgaagcgcctggtgctgcggagagcagatggagcagtggacatcgcaatgttcggaaggatgctggcagacgagccaggatataacagggaggcagcagtgcaggtgagccacgcaatcacaacccacagagccatcgccgaggacgattggtactctgccgtggacgatctgaataagagggaggatagcggcgcaggacacctgggagagcacggatttggctccggcgtgtactatctgtacgcctgcgtgaacgtggatctgctggtggagaatctggcaggcgaccgcgccctggcagcaaggggcctggaggccctggcaaaggccctggcaacagcaaccccaagaggcaagcagaactctcacgcccaccaccccagggcaatctatgtgagggcagagaggggaccacagcagcctagggacctgaccggcgccttcttttctgccgtggatctgaagagcaatgacatcgagcggacatccatcatcgccctggagagaaccgccgagcagatcgatagggcatacggagcagcatgcgacgatacagccgtgatggacgtgaaggagggaaacggcaccctggcagagatcgcagccttcagcggcgcatctgtgagcgccaatgcaggctccggcgagggaaggggctctctgctgacatgtggcgatgtggaggagaaccctggacctccgaaaaaaaagcggaaagtgggctctggcatgagcgacaggaagcaggtcatcggcacatggtggagaaccaggatcggcgccagaaactccaccgcagcaagggccctggcagcacggctgaatagaggagagggagtggatgtgctggcagagagggccgtgtttgagctgggaagggacctgggcttcctgaagcagccaaagcgcctggtgctgctggtgcgggtgctggcagccgtgagggaggataggggaggcgccctgcctctgaggctgggccagggcgaccctccacccctgagcccactgcggtttcagagactgctgagggcagaaggagaggagctgacaaccctgctgaggcgcgccctgccaatggtgacacgcacctgcgacgtgggcgccctgggagcagacctgctggattggtccgactctacacgcgcaagatgggcctttgcctatttcggcgccacccctccagccagaatcaacaatagcaggccaacacccgagacccccgccctgtccgatcaggagacagaggagggcagcggcgagggaagaggctccctgctgacctgtggcgacgtggaggagaaccctggacctccaaagaagaaaagaaaagtcggctccggcatggcactgtggcctcggtctctgccattcctggcccggagatacctgccaatgcgggagcacctggtgtttacactggccgccgccgtggcctccatgggagagctggcaggacacgagaggaggggcacctggtcttggcccggcagatctagcgtgctgggcctgtgcgcagccgccctgggcatccggcgggacggcgatttctccgccctggacggactgggactggcagtggccgtgtttgatacaggagagccactgagggacttccacaccgccgtgtccatcccatcctctgtggccaagaggccacagtctcgggcagatgccctgcgcatcgacgcaggccggagcaactccacaatcaccctgcgcgattacagggtgggcgtgctgtatggagtggccctgtggggcgacggactgcctaccgtggccgagaatctggtggaggccctgcagcgcccaacattcaccctgtacctgggccggaagagctgtccactggcagcaccactggcaccccgcgtgctgacagccccagatgcagcagccgccctgacagacggaatgaccctgccaccatggagagcaggagcaagggcaggccagatcgcaaccgaggaggagctgcctgcaccaagaacagagaccagacacgataggccaacagacaggaccgcctggcactttgcaccaagggccgtgcggctggtgccttgcgatatcgccccaagaacagcaggacaggtggcagcaggctctggcgagggcaggggcagcctgctgacttgcggcgacgtggaagaaaaccctggacctcctaaaaagaaacgaaaggtaggctccggcatgacactgtggctgagccgggtgcggatcgcaagaggagcagacctggataccctgaggccactgctggaccccagcgccctgcacccagcagcaatggaccccaagatgctgggctcccagacagacgcccaccacagactgatctggaccctgtttgccgattccagagacaggcgccgggacttcctgtggagggcagagggcgccggcaagtttacactgctgagcctgagaccccctaccgcctccagggtgtttgaggcccctgaggtgaaggccttcagcccagatctgctgccaggcgacaggctggccttcgccctgcgggccaacgccacccgcgatcgggccggctccgccaagggcagaagggtggacgtggtcatgcacgccctgcacaatgtgccacccgaggatagggcagcagcaaggatgacactggcacaggatgcagcaagcgactggctgaccggacagggagccagagcaggattcgtgcccgaggaggtgacagcaggcgactactccgtggccgccctgccttctcacaccggccggagaaagggccagccacagtatggcatcctggatctgacaggcgtgctgagagtgaccgaccctgcagcctttctggcaaggctgggacagggatttggaagagcaaggggattcggatgcggactgatgctgatcagaagggcaggcagcggcgaaggcaggggctccctgctgacttgtggcgacgtggaagaaaaccctggacctcccaagaaaaagaggaaagtgggtggcagccagctggtgaagtccgagctggaggagaagaagtccgagctgcgccacaagctgaagtacgtgccccacgagtatatcgagctgatcgagatcgccagaaatcctacccaggatagaatcctggagatgaaagtgatggagttctttatgaaggtgtacggctatcgcggcgagcacctgggaggctctcggaagccagacggagccatctacacagtgggcagccctatcgattatggcgtgatcgtggacaccaaggcctacagcggcggctataatctgcccatcggccaggccgacgagatgcagagatacgtggaggagaaccagacaaggaataagcacatcaacccaaatgagtggtggaaggtgtatcccagctccgtgaccgagttcaagtttctgttcgtgtctggccacttcaagggcaactacaaggcccagctgacacggctgaatcacatcaccaactgcaatggagccgtgctgagcgtggaggagctgctgatcggcggcgagatgatcaaggcaggcacactgaccctggaggaggtgcgccggaagtttaacaatggcgagatcaacttctctgctagcgagacacctggcacctccgagtctgccaccccagagtccggcggctctggctctagcggcggctctggctcctccggaggaatgacagtgagcctgaatctgatcaccgatcgctggattcccgtgctggacacaaccggaacacggcacaccatcgcaccttgggagatggccgacagctcctttgtggccccagattggcccagacctgacctgaacaccgcctgtctggagctgctgatcggactggtgcgcctggccgatccccctgcacaccccgacgattgggaggacaggcaggcccctgacgcagataggctgagggatagactggcaccttttgccccagccttcaatctgctgggcgacggcccacgcttcatgcaggagatgggaggactggtgggcgatgtgcgggcaacagacgtgctgtttatcgattccggcggcgacggaggcgccctgaccgtgagagagggcaggtacccaaacctggacctgccaacagcagcaatggcactgtatgcaatgcagacccaggcacctagcggcggaagaggaaatctgacatccctgaggggaggaggaccaatgaccgtgctggtggaccccggaggaggaatgtggcctctgatctgggcaaacgtgcccgacggcaagccagtggtgcctaatgtgctgccttggatgagaaggacagtgaccagcgagaccggcgtgaggttctttccacaccagggcgatgccgccgaggtgttctttggaatgccacgccggctgtggctggaggcacgcaacgactccgtgacaggcgtgatccagcggccctctggcaccaagtatgtgggctggcgccacccactgacaccctactataggcagaaggcaggcgataccccactgcccgtgaggcctagggcaggcgtgttcggatacaggcactggctgggaatcgcagcagagcagggctctgacctgagggagagaccagcaaccgtggaggcctgggagagccgcggactgggcagaagggccgatatcatcgtggccggctgggccatggagaatatgaaggcaagggactatatctggtcccgggcacctctggtgacactgccagaggagagagccgcctttctgagggatatgatcgaggccgccgacctgctgtctgccgccctgaggggcgccctggccaccctgctgggcgagggcgagggcagagaggccgccagggaggccttttacgtgagaacacaggccgccttcgagggctgggtgagctgtctggataccatcgccctggacgcagcagcaaggggatggctggccgatatgcggaaggtggccctggagatcttcgaggtgctggccctgccaggactggcagacagaaccatcctggtgcagcaggagatcgtggcagcacacaggggactgacaggcagcttctccggctacggcaagctgggcaccaaggcctttggcgtgctgaacctgcctgtgccaacacggaagaaggaggccgccacctga

SEQ ID NO: 1246 - DNA, 5736 bp, Pseudomonas sp. S-6-2
atgggccccaagaagaagagaaaggtaggctccggcatgacacgctttgtgcagctgcacctgctgacctcttatccccctgccaacctgaatagggacgatctgggaaaccctaagacagcaaggctgggaggagtggagagactgagggtgagctcccagtctctgaagcgcgcctggcggacaagcgagctgtttcagcagcagctggcaggaaccatcggaaccagaacaaagaggctgggcatcgaggtgttcgaggccctgctgggagcaggagtgaccgagaagcaggcaagggagtgggcaggacagatcgcaaaggtgtacggagccgccaagaaggataaccccctggagatcgagcagctggtgcacatcgcccctgaggagagggccagcctggaccagctggtggccacactggcagcagagaagagaggaccaaccgacgaggagctggatgccctgctgcaccaccagacagccgtggacatcgccatgtttggcaggatgctggccagcaagacccagttcaatggagaggcagcagtgcaggtggcacacgcaatcggagtgcacgcctccgccatcgaggacgattacttcaccgccgtggacgatctgaaccgcaatgatccaggagcagcacacatcggagagtccggctttgccgccgccgtgttctaccagtatatctgcatcgaccgggatctgctgaagagaaacctgggcggcgacgaggtgctgacacagaaggccctgcgcgccctgaccgaggccgccctgaaggtcggccccagcggcaagcagaattcctttgcctctagggcctttgcccacttcgccctggccgagaagggcacagatcagccacgctccctgtctctggccttcgtgaagccagtggcaggaaccgactacgcaggcgatgccgtggccgccctgcagcaggtgagggacaacatggataaggtgtatggcgtgtgcgccgagtcccgctgtcagtttaatgtgctgacaggagagggctctgtggcagacctgctggatttcgtggcagcagagggctccggcgagggaaggggctctctgctgacctgcggcgacgtggaggagaaccctggacctccgaaaaaaaagcggaaagtgggctccggcatgaagccaaggaagcctcggctgaatgaggcccagcagagatgggtgagggattggtggagggccctgcagccaagggcagagggcgacgagccaatccctggagagctgagcgtgatgggaaggggagagagggcacagctgcggagatgtaccgacgccgatgagctgctgacacagtccgccaccctgctgctggcacacaggctggtggccctgaacggagagagaggaccactgcccgataatagcctgtcctatgagaggatggcatgggtggcaggcgtgctggcaaacgtgaaggacgatctgagagatggcaagtccctggccacccacctgggacaggcagcagacgcagagaggcctccaatgtctgagctgcgctttcgggccatgcagagaggcacagccatgcaggagctgttcctgcactggaggcgcgccctgcagctggcaggaggcaagaccgacgtggcacacctggcagacgatctgctgagctggcagatcgagcagggacagtctgccgcacaggccagcaatggcgtgaagtttcactgggcctacgactactatctgtctgccagagatagggccgccgccaaggagccagagttcaacaaggagatcagcaaaggctccggcgaaggaaggggcagcctgctgacatgcggcgatgtggaggagaaccctggacctccaaagaagaaaagaaaagtcggcagcggcatgaccgactacctgctgctgaggctgtatggaccactggcatcctggggagagatcgcagtgggagagtctaggcacagcgccgtgcagccttctcgcagcgccctgctgggactgctgggagccgccctgggcatcgagagacacgacgatgcagcacagcaggccctggtggatggataccggttcgccatcaagctggagtgtatcggctctcccctgagagactatcacaccgtgcaagtgggagtgccaccaaggaagttccagtttagaagccggagacaggagctggcagcagacaaggtggatacaatcctgtccaccagagagtataggtgcgattctctggccctggtggcagtggaggccctgccaggagcacccgtggacctggccagcctggcagaggccctgcgcaagccaaggtttgccctgtacctgggaaggaagagctgtccactggccctgcctctgtccccaaagatcctggccgcctctagcgtgcgcgaggtgttcgataacctggagctgccttctctgctgggcctgctggacaggtaccagcctgagcaggcctggccaagcagacaggatcagcaggccctgaggccaggagtggcaaggtactattgggaggacggaatgacagcaggaatggcaccttcttttgaggcccagaggcacgatcagccactgagcaggcgccggtggcagttcgcaccaagaagggagtgggtggccctgaacgatggaggacagtccggctctggcgagggaaggggctccctgctgacttgtggcgacgtggaggagaaccctggacctcctaaaaagaaacgaaaggtaggctccggcatgtctcactacttcagcctggtgaggctgatcggctcccctaggcacgacgcctggctgagggatctgagcagacacggagaggcctacagggaccacgccctgatctggagactgttccctggcgacggagcagcaagggatttcgtgtttcgccggctggaggatgagaagtccttttatgtggtgtctgccaggccacctcaggcagacgcaggactgttccacatccagtccaaggcctactctccagagctggcagagggcgactgggtgaggttcgatctgcgcgccaaccccacagtgtctgtgagaagggagaatggcagaagccagaggcacgatgtgctgatgcacgccaagcagctggccagcaccgagaagtccgccctgcccgagcggctggaggcagcaggaagagagtggctgaaggacagggcagagcggtggggcctggacctgagaaccgattccctgatgcagaacggctacagacagcagaggctgaagcgcaagggcaagcacatcgccttttctacactggactatcagggcatcgcccaggtgaccgatcccgagcagctgcgccgggccctgctggacggagtgggacactccaagggattcggatgcggactgctgctggtgaagcgggtggatggcagcggcgagggaagaggctccctgctgacatgtggcgacgtggaagaaaaccctggacctcccaagaaaaagaggaaagtgggtggcagccagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctctgctagcgagacacctggcacctccgagtctgccaccccagagtccggcggctctggctctagcggcggctctggctcctccggaggaatggacctgctgtctgatacatggctgcagtgcaggcacagggacggcaccctgaagcctatcgccatcggccagatcggcctggaggactgtctggagctggtggcacctcggcccgacttccggggcgccctgtaccagttcctgatcggcctgctgcagacagcctatgccccagaggacctgcaggagtggagagatagatacgccaaccctccaaccgccgacgatctggccgaggtgtttgccccttatagggatgccttccagctggagaactccggcccaacattcatgcaggacctgaccctgccagacgatgtgaatcagctgcccgtgctggagctgctgatcgacgcaggctcctctagcaaccagtactttaataagccagcagtggagcacggaatgtgcgagggctgtttcacacaggccctgctgaccatgcagctgaatgcaccatccggcggaaggggcatcagaacatctctgaggggaggaggacctctgaccacactgctggtgccagccgagcagaacgccaccctgtggcagaagctgtggctgaatgtgctgcccctggacgccctggatcacccacctatcaagatgctgtctgatgtgctgccatggctggcaccaacccggacaagcgacgataagcagggccaggacacaccacccgagtctgtgcacccactgcaggcctactggagcatgcctaggcggatcagactggacgcagccaccctggaccagggcgattgcgccgtgtgcggagcacagaacgtgaagcgcatccggcactacagaacaaggcacggcggcaccaattataccggcacatggacccaccccctgaccccttattctctggatagcaagggcgagaagcctccactgagcatcaagggccggcaggcaggaaggggatacagggactggctgggactggtgctgggaaacgaggaccaccagcctgatgccgcccaggtggtgaggcacttcacagccaagctgggcaagccatccgtgcgcctgtggtgctttggcttcgacatgagcaatatgaaggccctgtgctggtacgattccctgctgccagtgcacggagtggcccctgacgtgcagaggaagtttacccgcagcgtgaagcaggtgctggactctgccaacgatatggccagcgtgctgcacaagcaggtgaaggccgcctggttcagaaggcccggcgacgcaggacaggagcctgcagtgacacagtctttttggcagggcagcgagaccgccttctatcaggtgctggagcagctgtccaagctggactttgattctgccgcagagctggcagcaatctacagagcatggctgcaggcaacccgccggctggtgctgagcctgttcgatcactgggtgctgtccggccctctggaggacatggatatgcagcgggtggtgaaggcaagagcagacctggccaaggagctgaacacaggcaaggcccagaagccactgtggaccatcgtgaatcagcacctgaaggagcaggcctga

SEQ ID NO: 1247 - DNA, 5709 bp, Salmonella enterica subsp. enterica serovar Muenster strain
atgggccccaagaagaagagaaaggtaggctctggcatgatcatgaccaccttcatccagctgcacctgctgaccgcatacgcacctgccaacctgaatagagacgagagcggcaggccaaagacagccttcatgggaggagtggagcggctgagagtgagctcccagagcctgaagagagcctggagggtgtccgagacctttgaggccgccatggatggcttcatgggcaagagaacacggagaatcggcgtggactacgtgtataggcctatgaaggatgccggcatcgaggagaagatcgccaagtctagctccgagctgatcgccaagcagttcggcaagctgaagagcgacaaggatgccaagccagagaagaacctggagatcgagcagatcgtgcacgtgagcaatcacgagatctccctgatcaagcagctggtggacaccctgatcgccgataagagggagccaaacgacgaggaggtggagctgctgcgcaaggagcagcggtccgtggatatggccctgtttggccgcatgctggcctctagccccgagttcaatgtggaggcagcatgccaggtgtctcacgccctgggcgtgagcgccgtgaccgtggagtccgacttctttacagccgtggacgatctgaacaataaggaggaggatgcaggctccggccacatgggagagcagggatttgcctctgccctgttctacacctacgtgtgcatcagccgcgacctgctggtggagaacctgggaggcaatgaggagctggccaagcggacaatcgccgccctgaccgagacagccctgaccgtgagccctacaggcaagcagaacagctttgcctcccgcgcatacgcaacctatgccctggcagaagtgggacagaagcagccacgctccctggcagcagccttctttcagcccgtgcgggacaccgatcagatccctgccgccatcacacgcctgaagcagcagcgggcctcttttgacaacgtgtacggcaattgcgccgacgattatagggagctgaacgtgcaggagggaaccggctccctggcagagctgctggccttcgtgtctcagggcagcggcgagggaagaggctctctgctgacatgcggcgatgtggaggagaaccctggacctccgaaaaaaaagcggaaagtgggctctggcatgctgaacagcaataccgccgtgctgtgcagaatcctgcaccctgacgcccagaaggccctgctggattggttcgccacactgagcgagcggtacgagcggaaggacggcaagcgcgtgaacggaagagcatggagggcagagctgaagaggatggcaccaccctacggcgtgatgatctgtgagggacacgacgccctgagacaggccctgctgaagcacatgaggctgcagcctctggatgagatggcactggccctgttcgtgagcgtggcagtgcacatcaagtctcacaaggccaacatcagcttcgccgcacagctgggagagaagctgaagggctccaccccatgcgtgtctgtgctgcgctttgagcggctgcagaaggccagcgaccccgagaccttctgtcagctgctgatccaggccgtgaagatcaggggcacagagggcgtgaatgtgctgtccctggccgatggcatcttcctgtggatggaggagtggcagaggcgcgagaaccaccagccagagtttcgcaaccccttcgagaggaatcgcatccggtgggccaatgagtacctgtctaccagccgcggcaagggctccggcgagggaaggggctctctgctgacctgtggcgacgtggaggagaaccctggacctccaaagaagaaaagaaaagtcggctctggcatgaaggagtacctggtgtttcagctgtatgcacctctggcaagctggggagaggaggcctccggcgagatcagacactctgccaccgtgccaacaaggtccgccctgctgggactgctggcagccgccctgggcatccggcgggatgaggaggccagactgaacaatttcaataggcactaccacctggcagtgcacgccctggcatcccaggacagatggctgagggattatcacaccgtgtctgccccccgcgagaacaagaagaatcggtactataccaggagggacgagctgacactggcccctgatgaagtgggcacactgatctctcagcgcgagtaccggtgcgacggctattggcacgtggcaatcagcgccacccccgatgcacctcactccctgtctgagctgcgggaggccctgctgacaccacacttccccctgtacctgggcagaaagagctgtccactggccctgcctctggcagcaaggctgatgaccggcacactgaaggaggtgtttacccacgcagtggaggagatcagcgccgcagagctgtccggcttcacactgagagagggcatctgctattgggacgatcctgacgaggagtccctggtgtggcagcagaagcagcacagcaacaatcagccagtgtccagacagaggtggcagtttggcggctacaccaggttcaacggaccactgcaggagaggacaggctctggcgagggaaggggcagcctgctgacctgtggcgatgtggaagaaaaccctggacctcctaaaaagaaacgaaaggtaggctctggcatgtatctgagcagaatccagctgaggtttaacaatctgagacccgagatgctggccaagtggaactccgccaggccttacgcctctcaccagtggctgtggcagctgttccctgagcaggagctgagacagttcctgtttagggaggaggcccacggcggcttctttatgctgagcgccatcccacccctgtcccagcactctctgtttctgatcgagaccaagcctttcaacccacagctgacaaatggcctggagctggactttcagctgagagccaaccccgtgatcacccgcaatggcaagcggtccgatgtgatgatgaacgccaagcaccaggccaaggccaatggcgtggagaaggagcggtggtgggagctgcagcagcaggcagcacaggcctggctggagcagcagggccagcagcacggctttagactgatcgccccagagcccgacgatttcgccatgtgggcaggcgacgagtacagcgagctgcaggcacactgcggatgcgtgcaggcctatcagcagcacagattcgtgaggaaggatcagcagaagccaatcaccttttcctctgtggacttctccggcgccctgtgcatcacagatgccgccctgtttaagcaggccctgttctccggcctgggcaagtctaaggccctgggctgcggcatgctgatggtgaagaggaagagaggcagcggcgaaggaagaggctccctgctgacttgcggcgacgtggaagaaaaccctggacctcccaagaaaaagaggaaagtgggtggcagccagctggtgaagtccgagctggaggagaagaagagcgagctgcgccacaagctgaagtacgtgccacacgagtatatcgagctgatcgagatcgccagaaatcccacccaggacagaatcctggagatgaaagtgatggagttctttatgaaggtgtacggctataggggagagcacctgggaggcagccggaagccagatggagccatctacaccgtgggctcccccatcgactatggcgtgatcgtggatacaaaggcctacagcggcggctataacctgcctatcggccaggccgacgagatgcagagatacgtggaggagaaccagaccaggaataagcacatcaacccaaatgagtggtggaaggtgtatcccagctccgtgacagagttcaagtttctgttcgtgtccggccacttcaagggcaactacaaggcccagctgacccggctgaatcacatcacaaactgcaatggcgccgtgctgtctgtggaggagctgctgatcggcggcgagatgatcaaggcaggcaccctgacactggaggaggtgcggagaaagtttaacaatggcgagatcaatttctctgctagcgagacacctggcacctccgagtctgccaccccagagtccggcggctctggctctagcggcggctctggctcctccggaggaatggacctgaccaaagagaagtggctgcctgtgatcttttctaacggcgagaagacaagaatcagcctgagggacctgctggataatcgcatccaggacctggcctatcctcggccagatttccagggagcagcatggcagatgctgatcggcatcctgcagtgtaccgtggccccagaggacaaggaggagtgggccgatatctggcacgagtctatcgagtttgagcagtgggagaaggccctgaacacaatcagcctggccctgcagttcggcgagcagaagccctcttttctgcagagcttcgaccctctggattccgagtacggctctatcgcaggactgctggtggacgcaccaggaggcaacgccctgaagctgaataaggatcactttgtgaagagaggcaacgtggagcagatctgcccacactgtgcagcaatcgccctgttcgccatccagaccaatagccctgcaggaggagcaggctatagggtgggaatgaggggaggaggaccactgaccacactggtggtgcctcaggaggaggacaagtacccactgtggaagaagctgtggctgaacgtgctgccacaggaggagccccctaatgtgacccagcacccactgatctttccctggctggcccctaccaagacatccgagaaggccggcaacgtggtgacacctgataatgcccacccactgcaggcctactggggaatgccaaggaggatcgagctggacttcacccacacagtggcaggaatctgcgacctgtgcggagagcaccacgagtccctgctgctgcagatgcgctctaagaactacggcgtgcagtatgactcttggctgcacccctttagcccttataggcaggccctgaaggacccctccgccccatggctggccttcaagggacagccaggaggactgtcttacaaggactggctgggcctgatgctgaacagggaggataagtttaataagatgcagccagcaaaggtggtgcgcgcagcaggccagcggaataagatgagcctgtggtgcttcgcctgggacatggataaggccaaggtgcgctgttggtaccagcacagaatccccctgatctccgtgtctcacgaggagcagttcctggccgtgctgaacatcgtgctggtgctggccagcgagtccctgtctctgctgcggaatgccctgaagagcgccaagtttgactgccctaaggaggccaagatggacttttccatggtggatatcgccttctggcaggagaccgagcctgccttcagaacactgcaggaggccctggcagtggacccactgagacaggatacccagacaaggcacgccgtgagccagtgggaggcagagctggcccactatctgtttcacgtgttcgaccgcgatgccctgaccaaccctgattgtccagacgatatcctgcagagacagctgacagcaaggcaggacctggcaagctcctacaggaagcacaaggcccggaaggatgtgctggccctggtggagtga

SEQ ID NO: 1248 - DNA, 5457 bp, Atlantibacter hermannii NBRC 105704
atgggccccaagaagaagagaaaggtaggcagcggcatgaacaacttcatcaacttccacgtgctgatctctcacagcccatcctgcctgaaccgggacgatatgaatatgcagaaggatgccgtgttcggcggcaagcggagagtgagaatcagctcccagtccctgaagagagccatgaggaagtctgactactatgcaaggcacatcggagcatctagcctgcgcacaatccacctggaggagctgagagatgtgctgaggcagaagctgtcccctcgctttgagctgccaatcatcgacaagaccctgtccctgctgtctggcaagacaatcgacgatgccgagaagatcaacggcgacgcagtgaccccatgggtgctgggagaggtggagtggttctgtgagcaggtcatgaaggccgaggccgagcagctggacgataagaagctgctgaagatgctgaaggacgatatcgccgccatgaggaccaatctgcagcagggagtggatgtggccctgagcggcaggatggccacatctggcctgatgagcgagctgggcaaggtggacggagcaatgtccatcgcacacgccatcaccacacacaccgtggactctgatatcgactggtttacagccgtggacgatctgcaggatctgggctccgcccacctgggaacccaggagttttcctctggcgtgttctacagatatgcctccctgaacatcgcccagctgcaggagaatctgggaggcgtgtctcgcgagcaggtgctggagatcgcagcacacctggcacacatgctggcaaccgaggtgccaggagcaaagcagcacacatttgccgccttcaaccccgccgatatggtcatgatcaacttcagcgacttcccactgtccctggccaacgcctttgagagccccatcaaggccaaggacggctacctgctgccttccatcaacgccttcaatgagtactggcagcggatcgccaagggatatggactgaccggaccagcagcacagttcatgctggcagaggccagcatggcaggaggaaacgtggtgtccgtggagaccctggagcagctgaagaagtggatctgccacgatggagaggccagccggggctccggcgagggaagaggcagcctgctgacatgtggcgacgtggaggagaaccctggacctccgaaaaaaaagcggaaagtgggctctggcatgagcaccgagatcgatgccatggccctgtataacgcctggcagcagctggacaatggcagctccgcccagctgaggcgcgtgagcgagcctgatgagctgagggagatcccagccttttaccgcctggtgcagccattcggctgggagaaccccgccaataagcgccctctgctgcggatggtgttttgcctgtccgccggcaaggacgtgatccaccacaaggagaagatcgacgattacccatccggcatctctctgggacgggccctggcaaagtctggcaagatcaacgagcggagagtgttccagctggtgagagcccagagcccaggcgatatgatccagctgaggcgcctgctgatccacgcagagcccgtgctggactggagcctgtttgcaaggcagctgacctggtggggcaagagggagagacagcagctgctggaggatttcatgctggccacacccgagagcaacaagaaggcaggctccggcgagggaaggggctctctgctgacctgcggcgacgtggaagagaaccctggacctccaaagaagaaaagaaaagtcggctccggcatgaagccatatctgatcctgagactggcaggaccaatgcaggcctggggacagcctacctttgagggcaccagaccaacagcaaggttcccaacacgctccggcctgctgggactgctgggagcatgcctgggcatccagagggacgatcggtctgccctgcaggccctgtctgagagcgtgcggtttgccgtgagatgtgatcagagcttcatcgacggccggaccatccctgtgacaggcctgagagattaccacaccgtgatggatgccagggaggactatcgcggcctgaagtctcacgagaccatccagacatggagggagtacctgtgcgacgccgtgtttaccgtggccgtgtgggagagcgagcaggccacactgaggctgccagagctgaaggtggccgtgtgcaagccccggtttacccctttcctgggcagaaagtcctgcccactgacacagcccctgttcgtggacctgtgcgacgccatcaacccttaccaggccctggcaaattatgcacctgcaggaggcgatatctattctgaggcacctccagacggaccatgccagacctttacagtgcgggacgagcctatcatcgccctgccaaggcagttcgcagcaagggagtggtacgtgatcaagggagcaagcgacgtgagccagggctctggcgaaggcagaggcagcctgctgacttgtggcgacgtggaagaaaaccctggacctcctaaaaagaaacgaaaggtaggctctggcatgtacctgagcaaagtgatcatccagaatgcctggtgtcgcgacgtgtaccagtttcaccaggccatctggcagctgttcccctctcagcctgcccagaagcgggccttcctgtttagaatcgaggcaaagcacccaggaaggggagcagacgtgctgctgcagagcatggaggcaccagcatctagcgccgcagcacaggtgctggcctgcaagcccctggcctttcacctgaaggagggcgatcagctgaggttccgcctgagggccaacccaatcaagaccatcaaggacgagcagcagcggctgaatggcagaggcgagatcaagagatgtagggtgcccctgctgaaggagcaggagcagcaccagtggctgatcaggaagctgtccctggcagcacgcctggagcacatcgagtccacctctgagctgcccctgttcttttctaagaacggcacaggcggcaagatccagcctatgaatttcgagggcatcctgaccgtgacaagcgtgcctgccctgctgtccctgctgaacaatggagtgggaccagcaaaggcaatgggatgcggcctgctgtctctggcaaggccaggcagcggcgagggaagaggctccctgctgacctgtggcgacgtggaagagaaccctggacctcccaagaaaaagaggaaagtgggtggctcccagctggtgaagtctgagctggaggagaagaagagcgagctgagacacaagctgaagtacgtgcctcacgagtatatcgagctgatcgagatcgccaggaatccaacccaggatcgcatcctggagatgaaagtgatggagttctttatgaaggtgtacggatataggggagagcacctgggaggctctcgcaagccagacggagcaatctacaccgtgggcagcccaatcgattatggcgtgatcgtggacacaaaggcctactccggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgagcggccacttcaagggcaactacaaggcccagctgaccagactgaatcacatcacaaactgcaatggagccgtgctgtccgtggaggagctgctgatcggcggcgagatgatcaaggcaggcaccctgacactggaggaggtgcggagaaagtttaacaatggcgagatcaacttctctgctagcgagacacctggcacctccgagtctgccaccccagagtccggcggctctggctctagcggcggctctggctcctccggaggaatggatctgctggtggacccatggattcccgtgcgggcctttgaggagaggcaccctcagaccatcacactgcagcggctgtgctgttccgaggagaagtggctgctgaatctgccaagagacgatatggagctggccgccctgcagctgctgatctgcctgctgcaggtgacctgtgagcctagggacgattctgagatgaggctgcgggtggcaaggccactgtctgaggaggagttcgccgccctgatgagcccttggcaccagacatttcagctggaccaccctcagatgccattcatgcaggtgaagggcgtggaggccaaggagccaacccccatggagaagctgatgaccggcctgagcggcgccacaaactgtgcctttgtgaatcagccaggacagggagaggccctgtgcggaggatgtacagcaatcgccctgttcaaccaggcaaacaatgcaccaggatttggaggaggcttcaagagcggcctgaggggaggaacccctatcaccacactgatcaagggctccgatctgcgcaccacaatctggctgaacgtgctgaccacaccccggctgcagtcctcttttcctccagacagactgaccgagaatctgcccacatggaagaggcctatcagctccggcaagacctttcctgcagcaacaatcggactgctgaggggactgttctggcagcctgcacacatcgagctgtgcccacctatcggaccaggacagtgctgtggatgtggacagcagtccaaccagcggtacaatggcttcctgaaggccaagtttaatttcacagtggagggactgtggcctcacccacactcccccagagtgctggtggagaagaagggcgtgatcgagcagaagtttctggccttcaccacagccgccccttcttggacccagatcggcaggctgctggtggataaggagacccgccagggagagggcaggcgcgtggccacagtggtggagcagtttcgggaggtgtaccctagattcaggctggccctgatcgtgggcggctatagaaacaatcaggccagcatcctggagcggagacacgatgtgctggtgtttaacgacggctggcagaatggctccgatgtgatcaacgacatcgtggagatgggcctgggctacaagaccgccctgaggaagggcctgtatacattcgtggagggcgccaagaatcacgacgtgaagggagcaggagtggcagtgcacgaggtggccgagcgccactactataggcgcagcgagctgctgatcccagcaatcctggcctccatcgattattctcagcctaacgacgtgatcgcaaggctgcggaaggagctgcaccagctgtgcgaggccctgttcaatcaggtgaccgcaccatacgcacaccacccaaagctgatccggtctctggcagtggcaagagccagcctgcacaagcacctgaacgagctgaagccacagggagagctggcatacgtggatggcgactga

SEQ ID NO: 1249 - DNA, 5448 bp, Geothermobacter sp. EPR-M
atgggccccaagaagaagagaaaggtaggctccggcatgcagaactttatcaattaccacgtgctgatctctcacagcccatcctgcctgaaccgcgacgatatgaatatgcagaagagcgccatcttcggaggcgtgcggagagtgcggatcagctcccagagcctgaagcgggccatgagaaagtccgactactatgcccagcacctgggcgaggcctctatcagaaccaagcacctgagcggcctgagggataggctgcacgagcgcctggcaggccggttcagccccgaagtgatcgacaagacaatcaagctgctgatcgacaaggatgtgagcgtggatggaatcgtggagggcgacgcagtggcaccatgggcagtggaggagtttgcatggttctgtgagagagtgatgaacgcacaggcagagggcctggaggataaggccctgaccaagcagctgaaggagtccatcgccgccatgagacagacactggtgggcggcctggatatcgccctgtctggcaggatggccaccagcggcctgctgtccgagctgggcaaggtggacggcgccctggcagtggcacacgccctgaccacacacaccgtggacgccgatatcgactggtttacagccgtggacgatctgcaggagctgggctctggccacctggacacccaggagttttctagcggcgtgttctacagatatgccagcctgaacatcggacagctgcaggagaatctgggaggagcaccaagggagcaggccctggagatcgcaacccacgtgctgcagatgctggccacagtggtgccctccgccaagcagcagtctttcgccgcccacaatctggccgatctggccctggtgtcctttgccgacatccccgtgagcctggcaaacgccttcgagaagccagtgcagcagaagaatggctctggctttcgggagccaagcatcgccgccctgcacgactactggcagaaggtgcacatcggctatggcctggaggagagatgcggccagttcgtgctgaacaaggtggagacccctgcaggaatcgcagcaaaggagtccctggaggatctgaagtcttgggtgcgcaacaatggagagggaggcagcggcgagggaaggggctccctgctgacctgtggcgacgtggaggagaaccctggacctccgaaaaaaaagcggaaagtgggctccggcatggccaaggagacagatttcatggacctgtaccaggcctggcagagactgccaaacggaccaaaggcagagctgaagaggtgcggcgatctgggcgacctgctggagaccagcgccttttacagactgctggcaggaaggggagaggcagagtggcagaagaaggcctatcagcggatgatcttctgcctgccctgtatcaatcacacagagcagaagatccctctgggagccgccctggcacggagcagaaagggcagccggagcgccgtgagcgagtctaggatgatccaggtggtgcgctccgaggcaccaaacgatatggtgcagctgaggcgcatcctgaagcacgcagagccaaccgtgaactggcctctgatggccaagcagctgtggtactgggacctgaatgagaggagcaagcggagcctgctggaggatttctttctgaaccacaccgacacaagcaaggagggaggctccggcgaaggcagaggctccctgctgacttgcggcgatgtggaggagaaccctggacctccaaagaagaaaagaaaagtcggctctggcatgggcgactatctgatcctgaagctgcagggacctatgcaggcctggggagagcacagctttgagggaacccgcccatccggcaatttccccacacggtctgccctgctgggactgctgggagcatgtctgggcatccggcggaacgagtacgagaggctgcagcagctggccgatagcgtgcagtttgccgtgagaaaggacgccaggcagacccagacagagtggggcgagccaaagaagctgcccatggtgaagatgaccgattaccacacagtgaaggacgccagacagtcttatatcggcctgaagagccacgagaccatccagacatggagggagtacctgctggacgccgagtattctgtggccatctgggagaatgaggatgcagccgtgagcctggacgagctggagaccgccgtgaggaagcccgtgttcaccccatacctgggcaggcgcagctgcccactggcacagcctctgttcggcaagcgcctgaccgcagagtccccaaaccaggccctgcaggcagtggagccttccggcggcgtgatctattctgagcagccctctgatcgcagcatgaggctgagggacctgcctatggcaggacagccaaggcagttcgcatctcggaccgtgtacatccacggaggcgatcacgtgtccgagggctctggcgagggaagaggcagcctgctgacatgcggcgacgtggaagaaaaccctggacctcctaaaaagaaacgaaaggtaggctctggcatgtacctgagcaaagtgatggtgaccggagcagcatgtaggaacccatatgagatccaccggtccctgtggcagctgttccccgaggaccccgacgcacggagagattatctgttccgggtggagagagcaggcaggcagcaggcagagatcctgctgcagagccagcggaagccaagcgactccgagctgcgcaaggtgcggctgctggcaaccagaggataccagccaaggctgcagcagggacagcggctgagatttgccctgctggccaaccctgtgaagacaatcaatgatgagaggggccgcctgaacgcaaagggacaggtgaagaagtgcagggtgccactgatcagggaggaggagtggagaagctggctggagcacaagctgatcggatgtgcagagctggagaccctggtggcagagaacaggctgcccatcaacttcagaaagccaaaggagaagagggtgggcaagatccagcccgtgagcttccagggcatcctgagagtgtcctctccagaggccatgatgcaggccatctctaccggcatcggaccagcaaaggccttcggctgcggactgctgagcatcgcaccagcaggctccggcgaagggaggggctctctgctgacatgtggcgacgtggaagaaaaccctggacctcccaagaaaaagaggaaagtgggtggctcccagctggtgaagtctgagctggaggagaagaagtccgagctgagacacaagctgaagtacgtgcctcacgagtatatcgagctgatcgagatcgcccgcaacccaacccaggatagaatcctggagatgaaagtgatggagttctttatgaaggtgtacggctatagaggagagcacctgggaggctccaggaagccagacggagccatctacaccgtgggctctcccatcgattatggcgtgatcgtggacacaaaggcctacagcggcggctataacctgcctatcggccaggccgatgagatgcagcggtacgtggaggagaaccagacccggaataagcacatcaacccaaatgagtggtggaaggtgtatcccagctccgtgacagagttcaagtttctgttcgtgtccggccacttcaagggcaactacaaggcccagctgacccggctgaatcacatcacaaactgcaatggagccgtgctgagcgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaacctgctgacagatccctggattcccgcaaggccacagggaagggcaaccgcacagaagctgacactgagacagctgctgtgcgaggacgagaggtgggagctgagactgcccagggacgatatggagatggccaccctgcagctgctgatctgtctgacccaggccctggcaacaccagcagatctgcccgagctgaagcggagaatcatgaagcccctgggccagcaggagtttaatgccgcctacaccccttttgccgattggttccgcctggaccacccccagtatcctttcatgcaggtgcggggagtgaaggcaaaggagccaacacccatggacaagctgctggcaggactgaccggagcaacaaacagctgttttgtgaatcagtccggcctgggagagggactgtgcccagcctgtgccgccatcgccctgttcaaccaggccatgaatgtgcctggctttggaggaggcttcaaggcctctctgaggggcagcgccccagtgaccacactggtgcagggagagcacctgaggcagaccatctggctgaacgtgctgtctacagagagcgtggaggccctgctgccatggcacaggcagaccgaggaccagaagcccacatggatcgcccctatcaagagcgagaccttcagctccagatccatcggctttctgaggggactgttctggcagccagcacacatcgagctgctgcctgcagagagcgtgggcgattgctcctgctgtggccagggcgacacagaggtgtacaggggctttaacaaggccaagttcaattataccgtgacaggaatctggcctcacccacacggagcacgcaccagcacagtgaagaagggcgagcaggaggagaagttcgtgagcttcaccacagaggcacctagctggacccagctgggccgctttgtggcaaggagggccttcgtggatgcaaagacacctggacaggagccagcagccgtgatcaggcaggcacagaagctgggcgtgcggctgaccctgtgcatcggaggctataggaacaatcaggccagcatcctggagcggagacacgagctgctgccactgggagagggatggaattccaagccccagatcgtgcaggatgtggtggacacagccatcggctaccgcgacgccctgaacaagtccctgtattctttctttaagggaggaggctccaagggagcaggactgcctatccacgagtttggcaaggcccagttctacaggcgcaccgaggaggccatcctggattccctggccagactggacttttctaatcccaggcctgtgctgctggccctgcagaagaagctggatacagaggtgagaggcctgttcgaggaggccgtgaggccatacctgaacgaccccaatctgatccacaccatggccgtgagccggagaacactgtataagaacctgaatgtgctgaagccacagcaggagggaggagtggacggcaagagaaactga

SEQ ID NO: 1250 - DNA, 5484 bp, Methylocaldum sp. 14B
atgggccccaagaagaagagaaaggtaggcagcggcatgaccaagaagaactttatcaatttccacgtgctgatcagccactccccttcttgcctgaacagagacgatatgaatatgcagaagacagccgtgttcggcggcgtgaatcgggtgagaatcagctcccagtccctgaagcgggccatcagaaagtctgactactatcaggccaacctgggagcaccaagcgtgaggacccgcgatctgaataagctgaaggcccggtttacagagctgctgaaggacagattcgatgccgagctgatcaacagggccctggagtggatctccggcaaggagggcatcgcagagggagtgaccgcagacgcagtggccccatggtctgtggatgaggtgacacacttttgtgagatcatcagcgccgacgatcagcaggacatcaagaagctggagaagcagatcgagaaggaggcaaggcccttccgcgcagcaatgagcaacaccgtggacatcgccctgtccggcaggatggccacatctggcctgatgagcaatctgccagtggatggcgccctggcagtggcacacgcaatcaccacacacgccgtggagcctcaggacgtggattggttcaccgccgtggacgatctgacacaggacgcaggcgataccggagcaggacacctggatacccagcagttttctagcggcgtgttctacagatatgcctccctgaacctgcgccagctgcaagtgaatctgggcctgatcgaccacatcaaggcagaggagaccgcagagtctcggcagagagccctggatatcgcccaccacgtgtttcacctgctggccacagtggtgccttccgccaagcagcagtctttcgccgcccacaacctggccgactttgccatcgtgagcttcgccgatcagccaatctccctggccaatgcctttgaggagcccgtgcggagagactacaagctggccggcttcctgaagccatccatccagtgcctggccaactactggggccggatgaatagagcatatggcctggacgagcaggcaagggcctttgccgtggatgccagcttcgagatgggcggcaagccccctctggattccctgaaggccgtggaggactggatcgccgaggatggacaggagggcagcggcgagggaagaggctccctgctgacctgtggcgacgtggaggagaaccctggacctccgaaaaaaaagcggaaagtgggcagcggcatgacagcagagctgccagattttgtggccctgaagatgcactatgacgatgagtccttccccaccggagcaagggcagagctgaggcgcgcagccgagcctgacgatgtggccctgacaccagccctgtacaggctgtttcctggagagaggccatctgacaggcacctgcgcgtggcatacctgctgccctatgccaagcacgccgccaaggccaagagcctgggagcacagctggcagaggcaaaggtggccgaggcccgggtgctgcaggtggccagagcacacgagcccctggacgtggtgcagctgcggagactgctgatgcaggtggaggcagcagtggattggtccgcctttggccctatggtgtggttctggaacgagcgggccaagagacagctgatcgaggacttttatatcgcccgcttctctccagtgaccggagcaaagggctctggcgagggaaggggcagcctgctgacatgcggcgatgtggaggagaaccctggacctccaaagaagaaaagaaaagtcggcagcggcatgcctcggtacctgatcctgctgctggacggaccaatgcaggcctggggaacacacacctttgaggatttcagaccctgcaacgccttccctaccaggagcggcctgctgggactgctgggagcctgtctgggcctggacaggcgcgatacagaggccctggagcagctggccatgtccgtggagtttgccgtgagggcagacagggaggtgctgaggccagaggcagaggtgccaaaggcaaaggcagcagtgaagctgccagatttccacaccgtggaggacgcccgcaaggtggatggctctgccaacaagaatcccgtggtgagccggagagagtatctgtttgacgcagccttcaccgtggcaatcggagcaaagcctgacggaccagtgacactggatgcaatcgcagaggccctgaggcgcccctgctttacccctgtgctgggccggagatcttgtccaatcgccagaccactgctggacggagaggcagtggaggccagcgatgccaaggccgccctggcaaccatcgcaccagtgggcggcatgatctatacagagggagagctgatctccgcccagccactgagggtgcgcgacgtgcctatccagggccggcacagacagttctctacccgcctggtgtacctgcacaagggcgagacatgcagcggctccggcgagggaaggggctccctgctgacttgcggcgatgtggaagaaaaccctggacctcctaaaaagaaacgaaaggtaggcagcggcatgtttctgtcccgcgtggagatcccatgggacgccgtgcggaacccctacgagatccacaggcagctgtggaggctgttcccaggagaggataaggagcctcgcaagaatgccgaggagggcaggcagggcttcctgtttcgcgtggagaacaatcagcccggccggcctctgagactgctgatccagagcaggagggcccctgagccaacagcaggactgaccatcgtgggcacaagagagtttcagccacagcctgcacacggacagaggctggccttcctgctgacatctaaccctgtgaagaccatcatcgacgcccagcgcgagaccaagagcggcaagtcctctgagaagtgccgggtgccactgatccacgagtccgagcagagggagtggctgaagaggaagctgatcggagcaggagagttcgagggagtgaacgtggtgccacacgcacccgtgttctttcggaagggcaatagaggcggcaagatcgtgatggtgacctttgagggcgtgctgagggtgaacgagccaggcacactgatcgcctatctggagaatggcatcggaccagcaaaggccttcggctgcggactgctgctggtgcggagactgggaggctccggcgagggacgcggctctctgctgacctgtggcgatgtggaagaaaaccctggacctcccaagaaaaagaggaaagtgggtggctctcagctggtgaagagcgagctggaggagaagaagtccgagctgagacacaagctgaagtacgtgcctcacgagtatatcgagctgatcgagatcgcccggaacccaacccaggacagaatcctggagatgaaagtgatggagttctttatgaaggtgtacggctataggggagagcacctgggaggctcccggaagcccgatggcgccatctacaccgtgggctctcctatcgactatggcgtgatcgtggatacaaaggcctacagcggcggctataacctgcctatcggccaggccgacgagatgcagagatacgtggaggagaaccagaccaggaataagcacatcaaccctaatgagtggtggaaggtgtatccaagctccgtgacagagttcaagtttctgttcgtgtctggccactttaagggcaactacaaggcccagctgacacgcctgaatcacatcaccaactgtaatggagccgtgctgagcgtggaggagctgctgatcggcggcgagatgatcaaggccggcacactgaccctggaggaggtgaggcgcaagtttaacaatggcgagatcaacttctctgctagcgagacacctggcacctccgagtctgccaccccagagtccggcggctctggctctagcggcggctctggctcctccggaggaatgaatctgctggaggacccttggattcccgtgcgggcagatggaggaaccggagcattccagctgctgacatacaggcagctgctgtgcgagccaggaaactggcaggtgagcctgccaagggacgatctggagctggcctgcgtgcagctgctggtgtgcatgacccaggtcatgtttctgcctgagaatgacgccgtgtggaggaagcgcctgaccgaggccctgacaagagaggagttcacagccggcaccgagccatgtctggactggtttgacctggatcaccccacccagcctttcatgcagtctaggggcgtgcgcgcagcagaggatacaccaatccagaagctgctgatcggcctgcctgagggcaacaatcacgccttctttaatgaggcaggagaggtgcggcacctgagcgtgaccgtggccgccatcgccctgttcaaccaggccacaaattgcccttcctttggcggaggcttcaagggctctctgaggggaggagcaccaatcaccacactggtcaacggcgagaatctgcgggagaccgtgtggtgtaacgtgctgacacggtccagactggcagcaaggcagatcgcaatgccaggcctggacagggataggcctacctgggtggagccaatccaggagaaggccaccatcccctggaatacaatcggactggcaaggggactgttttggcagcctgcccgggtggagctggtgagaagcatggcagcagcaccttgcgacgtgatgggaggagcaccaaccctgggatatgtgggcttcagaaaggagaagtttaacttcacagtggagggcgtgtggccacacccacacggagccatcacaatgaccctgaagaagggcgccctggagcagaagtttgccagcttcaccacaaccgcacctgcatggacccagctgtccgagttcgtggtgccaaagggagtgaacgatccaggagcaaaggagggctccatcccagcaggaccagtgacccaggcctccgagctgggagagtctggcctgcacctgctggtgggaggatacaggacaaatcaggccagcgtgctggagcggagacacgagatgatgtccctggcccggggctggagagacgataagagccggctgccaaagctggtggagatgggcaaggaggccaagaaggccctgaggggcaagctgtattttgccgtgcagggcaacaaggacaagggcctgaagggaatcggagcagcaatccacgagaccgccgagaagctgttctacgccagaacagagtctctgatccacgagaccttcagcaatgagctgaccttcaagcagtgggccacagccagaaaggcctttgtgcaggagctggcaggacactgtagggcaatcttcgaggagctgaccgccccctacgccatgaagcctgagctgatcccagtgatcgcatgggcaaggcgcagcctgaacttcgacctgacaaagctgatggaggatgcctga

SEQ ID NO: 1251 - DNA, 5910 bp, Methanocella arvoryzae MRE50
atgggccccaagaagaagagaaaggtaggcagcggcatgaagctgatcgagatccacatgatccagaaccacgccccctgcaacctgaatagagacgataccggcagccctaaggactgtatgtttggaggcatccggcggagccggatcagctcccagagcatcaagagatccatcaggatgtctcctatcttcaaggaggagatgaagggcatcgagctggccaatcgcacaaggcgcctgccagagctggtgaaggccaagctgatctccgatggcatcgacgagaagatggcagcaatcgcagcagagaaggcaacaggctttggcaccaaggatggcaaggagcgggaggaggacctgaatacagcccagaccatgttcatcacccagtccgacgtggatgccgtggcctctgtgatgaaggatgccatcctgaaggccggcaaccccaaggccttcaaggatatgaaggcagcagacctgcagaaggcagcagagctgaagggatggagaccagtgacacctgacctggccctgtttggcaggatgatcaccagcgatgccttcatggacatcgaggcctccatgcaggtggcccacgccatctctacaaataagatggatcacgagtttgactacttcaccgccgtggacgatctgcagaagtctagcgacggacctggagcagatatgatcggcgacgtgcagtttaacagcgcctgctactataagtacttctccctggactatgatgccctgatccagaacctggccggcctgaagccaggcgataatgccaccgaggccgacaagaaggcctatgccgagtccctggagaatgccaagaaggtggccgccatcaccatcacagcctttctgaaggccgccatctacaccacaccatccggcaagcagaactctttcgccgcacaccagctgccaagcgccgtgctggtggagatcaggccaaccaagacacccgtgtcctacgcaaacgccttcgtggaccccgcaaggccccgcaatggcgtggatatggtggaggacaccctgaacaagttcgtgaagcacgtggagctgcagacagagaagtttaacctgcggagcacccggagactgtggttcgtggcaggcgacaaggccctggcaggaaccgagacatgccagacaatcaacgatctgatcagcggcatcaattccgccctgggctctggcgagggaagaggctccctgctgacctgtggcgacgtggaggagaaccctggacctccgaaaaaaaagcggaaagtgggctctggcatgacagccccaaacgagaataaggagcaccagaagagcaagaaggacgaggagttcctggccaacctggcaaagatggcagagagcgataggggaggaatggccatcctgaagcggaacgccggcaatacaatcgccgagagccggggcgccatgaagaccttttacagcctgctgccatatggcatcagcgactccccctacgaggagatctatttcctgatcgccaccctgtacggccacaacaagtataggtttacaggcgacttcggccagaccatgaagctggtgcgcgagtcctctaattctgagagcatcgatcagcgggtgagcacactgctggattccgagtttaacatcgtggacggcatcaagccaggaggaggagagctggcatacaggctgaggcagtgcgtgaagctggcaagcggccacgagatcggagtggattggtatagactgctgcaggacctgaagtactggggctatccagagaagagggtgcagaagcggtgggcccggtcctacttcggctatggcaagcccgtggagtctgagaccaaggagagcaaggaggaggcaaaggcaggctctggcgagggcagaggcagcctgctgacatgcggcgacgtggaagagaaccctggacctccaaagaagaaaagaaaagtcggctctggcatggataacccactgctgctgctgctgcggctggagggaccaatgcagagctggggcctgaaggcaagatgggatatcagggacacaggcgatgagcccaccaagagcggcatcatcggactgctgggatgcgcactgggatacgccagaaaggaccccaggctgaccgacgagctggattcccagctgcgcatcggcatccgggtggagtgtcctggcgagatcgccagggactatcacacagtgagcggcgagctgcgcaccgcagagggcaagctgcgggagaccacaatcgtgtcctttagagattacctgcaggacgcagccttcctggtggtgctggagggaccaggagagctgctgaccaggatctccaacgccctgaaggaccccgtgtggccaatctacctgggcagaaagtcttgccctccaacaaggcccgtgttcgagaccctgaccacagactatgcctccatcgacgatgccctgagccggcacccttggagctccggcaccatggaggcaaggaaggcacacccaaaggagctgaagtgtatcgtggaggacctgtctggcccataccagagaacagataggatgaccaagagccccgccagaatgtatggcatccgccacgtgcggatgagcaccgtgaagctgcaggcagagggagagggactgggcagcggcgagggcaggggctccctgctgacctgcggcgacgtggaggaaaaccctggacctcctaaaaagaaacgaaaggtaggctccggcatgtacctgtctcggctgatcctgaaccctaggacccgcgccgtgaggcgcgacctggcagattgtcacgagctgcaccgcacaatcctgggcggctttccagacctgaacggcaagggaggagaggcaagggagaccttcggcgtgctgcacagaatcgatatccacccaaggagcggcgcaatcgtgctgctggtgcagagccaggagaagcccgactggtccaagctgcctgagggctacctgctggagaacaccggcacagagaatcctgcctgcaaggccatcgacgagcagtacggcaagatcaaggcaggcgacgtgtacgccttccggctgagagccaatccaacaaagaagatcggcaccagccggatcgaggatatcaaggccggcaagcccaagaacaatggccggagagtgcctatccgcaacgagagcgaccagatcctgtggctgaagaggaagggagcagcaggaggatttgagctgatgagcaccaagaggttcagcgagctgtccgacgtgctgatctccgaggagggccaccagaagatctatacattcgataccggcatcaaggccaaggtgcagaagaacgccagagagaataggctgacctttggcagcgtgctgttcgagggcacactgaaggtgaccaatgccgagaagtttctggagacactgaagagcggcatcggctccggcaaggcctacggattcggactgctgtccctggcacctgcaaggggctctggcgagggacggggcagcctgctgacttgcggcgatgtggaggagaaccctggacctcccaagaaaaagaggaaagtgggtggcagccagctggtgaagtccgagctggaggagaagaagagcgagctgcggcacaagctgaagtacgtgccccacgagtatatcgagctgatcgagatcgccagaaatcctacccaggatagaatcctggagatgaaagtgatggagttctttatgaaggtgtacggctatagaggagagcacctgggaggctccaggaagcctgacggagccatctacacagtgggctctccaatcgattatggcgtgatcgtggacaccaaggcctactccggcggctataacctgccaatcggacaggcagacgagatgcagcggtacgtggaggagaaccagacccggaataagcacatcaacccaaatgagtggtggaaggtgtatccctctagcgtgacagagttcaagtttctgttcgtgtctggccactttaagggcaactacaaggcccagctgacacgcctgaatcacatcaccaactgcaatggagccgtgctgtccgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaagaatcgcgtgaagcggggcgagcacctggtgtcttataacctgctgacagagccttggatcacctctatcgatctgagcggcaatccagtgcaggagggcatcctggccaccctgaagaacgcccacaagatcgatagcatctttgaccctgcccctccagtggagttcggcatctacaggctgctgatcgcctttatcaccgacgtgttccagccacagggcctggaggacctggcagatctgctggacaggaagcggctggaccccacagccctggacgagtacgcagcacggtggagagataggtttgacctgttcgatgagaagtatccattcctgcagcaggccatcaccggcgtgatcaagaagccccctgagcccatctctcgcctgatgcagcacctgcctgccggcacaaatgtgagccactttcaccacggccggtgggacgagaactcttttagcttcgagcagtgcgccaagggcctggtgacaatcgcacccttcatgaccgcaggaggagcaggcctgtccccttctatcaacggcagcccaccctggtacgtgctggtgaagggcaacaatctgtttgagacactgctgtataacgtgtgccagatccccatgaccgtgaagcctatcggcgatagcccagtggcctggagaaacgacaagaggatcgaccctggcgatgagccaaagacattctccatcgtggagggactgacctggaggcctcggatcatccagctgatcccaggcaatggcaagggcacctgtacatataccggcgagaaggacgtggataccgtgtcccacatgcactactatccaggccagaagtctcctgagccaggactgtgggtggacccccaggtggcatacaagaagacaaaggatgccatcagacccctgaggcctgacgagaataaggccctgtggcgcgatatcggaccactgatgctgctgcagcacggcgattactctggcaaggacggcaaggtgagcttcgatcggccagccgtggtgacccagtataagcagatggtgtccaacggcatgatcaagcggagcgagccactgcggctggaggtgtacggcatccgcacagacggcaagatgaagatctacgagtggtatcacgagaagctggccctgcccatcgagatcctgaagaaggccaattccggccggcagatccaggacgccatggatctggccgactctgtggcctacatcctgagaaaggccatgaagaaggcctatcctaggaacgccaagtccaatgagtctggctttgacaacctgatcctgagcgtgcagtctagctattggtcccacctgaagggccagtttgagtctatcttcctgaagacactgagccagcaggatgagaatgacctggatgcctacaccaagctgatggagcagtggaagaagatcctggacgatacaggcaagaacgccctggacaagggactgggacccctggacaccgatggcgactccctgcggagacaggtgaaggccatgaacgagtactcctctggcatcagattcgccctgtatcctgactctatccaggccaagaagaagaacaggcagaagaataaggaggataagtga

SEQ ID NO: 1252 - DNA, 5592 bp, Pseudomonas aeruginosa DHS01
atgggccccaagaagaagagaaaggtaggcagcggcatgaacctgtttatcgagttccacctgatccagaattttgccccatccaacctgaatagggacgataccggagcaccaaaggacgcaatctttggaggacacaggagagccagagtgagctcccagtgcttcaagagagccatcaggctgaccgcccacgagcaggagctggtggcccccgagcacaggggcgtgcggacaaagaagctgaaggccctgctgctggagaggctggcaggacgcgatcctgcagaggcagagggcaagatcgagaccgccctggcagcagcaggcctgaagctgaaggacgatggcaagacagagtacctgctgtttctgggagaggcagagatcgcaggattcgccgccctgatcgagcagcggtgggacgagctgggcagcgccgcaccagccggcgagaagaagggcaagaaggaggccaaggccaacgtgcccaccgaagtgatcaagcaggcaagggccctgctggatggaggcaaggcagtggacgtggccctgttcggaaggatgctggccgatctgccagaggtcaatcaggacgcagcatgtcaggtggcacacgcaatctccacccacagggtggagagggagtttgactacttcacagcagtggacgataggggaggccccgatgagtctggcgcaggaatgatcggccaggtggagtttaacagcgccaccctgtacagatatgcagtggtggacctgcgcaagctgctgggaaacctgcagaatgatggagagctggtgctgtccgccctggaggccttcacccaggcaatggtgcgcgcaatcccatctggcaagcagaacacatttgccgcccacaatctgcctgccttcgtgggaatctgcctgaggcacgcaggaccactgaacctggccaatgcctttgagaagccagtggtggcaagggcagacgcctccctgtctgagcggagcgtggcagagctggcaagacacgatcagcagctggcaagcgtgtacggcgacagccgggatagatgggcctatctggacatctccggcgcatggccaaaggagagaggagagccagcaggaaacctgcagcagctggccgattggctgaggtctcaggtgtctagccgcctgggaggaggcagcggcgagggacggggctccctgctgacctgtggcgatgtggaggagaaccctggacctccgaaaaaaaagcggaaagtgggcagcggcatgtccgccgcagagcacccattcatcggacacctgcagaggctgcagaatgacaggggcgccctggccgtgctgaggcgcagcctgggatttgcacctggagcatatgtgccagcatacccatatgtggagcggttcgtgggagcagagagacacgcacaggatgcctggaggctggccctgtacctgaccgcaggactgtttgcatcccacccaggacagggaagggcctctctggcaatgaggttcggagagctgatgaaggccaggaacagcgcctccatcgagaagcggttcatcgccctgctggcagcagacgcagagaatctgcccgtgtatctgagacaggccgtgagcctgctggcagcagataagctggccttcgactacggcgccctgctggacgatctggcacactggctggacccctatctgccagtggcaaggggcgacgcaatcaggcagcggtgggccagagacttctacgccgccctggccaacaccacagatacctctctgcacaaggacggcagcggcgagggaaggggctccctgctgacatgcggcgacgtggaggagaaccctggacctccaaagaagaaaagaaaagtcggctccggcatggccaccctgctgatgaggctgcagggaccaatgcagtcctggggaaccacatctcggttcgacgagagagatacacagctggagccttctaagagcggcgtgctgggactggtgtgcgccgccctgggaagggatagaagcgagccactggaggacctggcctccctgcggatgggcgtgcgcgtggatagggagggcatccccctgagagactatcagaccgcaacaggcgtgctggtggcatccggcaaggccgatcccaggagaaccgtggtgtctcctcggcactacctggccgacgccgtgtttctggtgggcctggagggcagagatcaggccctgctggagagaatccagcaggccctgagagcaccattttggcctctgtgcctgggaaggaagagcttcgtgccaggctcccccgtgtggctgcctgagggactgtcctctctggccctggagcaggccctgcaggcctggccaagactggcagaggcacagcctggcgacaggggcaagccactgagatgtctgatcgaggacgagaggagcggcgtggtgcgcctggatcagcctatcgcaccattcgccgagaggcgctttggaccaagattcgtgaggtccggcgtggcagacgtgcccgatcagaccgaccctggctctggcgagggaaggggcagcctgctgacctgtggcgacgtggaagaaaaccctggacctcctaaaaagaaacgaaaggtaggctctggcatgtatctgaccaggctgaccctggacccccgcagcgcccaggcacggagagatctgggcgacgcctacgagatgcacaggaccctgagccgcgtgtttgcagacgagcaggcaccagcatcccggttcctgtggagactggaggcctctggcaacgcctggagcacccctacactgctggtgcaggcagcatccgagggaaattggtctgtgctgcaggccctgccaggatacctgctgggagagccacagtccaagtctctggccctgaggcagtggctggagtctgacatcagctacaggtttcgcctgttcgccaatcccaccgtgacaaggcagggcaagcggtacggactggtgggagaggagcagcagctggcatggctggcaaggcagggcgagagacacggctttgtggtggaggccgccctggtgaccttcagcgaggtgctgggctcccggaagagacagacacggatctccgtgctgagagccgcctttgagggcaggctgcgcatctctcgcccagatgccttcggccaggccctggtggcaggaatcggacccgccaaggccttcggctgcggcctgctgtccctggcaaggagcggctccggcgaaggcaggggctctctgctgacttgcggcgacgtggaagaaaaccctggacctcccaagaaaaagaggaaagtgggtggctctcagctggtgaagagcgagctggaggagaagaagagcgagctgagacacaagctgaagtacgtgcctcacgagtatatcgagctgatcgagatcgcccggaatccaacacaggatagaatcctggagatgaaagtgatggagttctttatgaaggtgtacggatataggggagagcacctgggaggcagcagaaagcctgacggagccatctacaccgtgggctccccaatcgattatggcgtgatcgtggacacaaaggcctactccggcggctataacctgcctatcggccaggccgacgagatgcagaggtacgtggaggagaaccagacccgcaataagcacatcaaccctaatgagtggtggaaggtgtatccaagctccgtgacagagttcaagtttctgttcgtgtctggccacttcaagggcaactacaaggcccagctgacccggctgaatcacatcacaaactgtaatggagccgtgctgtccgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaccgagcactataacctgctggacacaccatggctgcctgtgcggctggcaaatggagaggtgagagagatgggcctgctggaggtgtacagggaggcagagaggatctctgccctggcagagaccgagccacccagcctgatcgcccagtaccggctgctgctggccatcacacacagagccctgctgctggagtatggagcatggaaggactccggccggctgagatggtttagggagggcctgcctatcgatgtggtggagcggtacctggagcggtggagggagcggttttggctgttccacccacagtatcccttcatgcaggtggccgccctggcaagcgccgcagagacctgcgataagcagaagccatgggcacagatcagcctggcatccgccaacggcaatacacctgtggtgttcgatcactcctacgacctggccccatctgccgtgagcgccgaccgggccctgtgcgcactgctgggctttctgcagttcaccccaggaggactggtgaagacagtgcgcgacagcgataaggcaggcgccctggcaaacaccgcagcagtggtgccactggcagacagcctggcaaagacactgtgcctggccctgcacccagcatccggcgaggcagcctttgatctgcctgcctgggagagagaggccctgaccatcccacagctggcagccgaccctatcctggcatccggcccaaatgatcgctatacacggcagagccgggccgtgctgctgctgcccgaggaggagggctgcgtgcggtggatcagattcgcagcaggacaggccctggcagacgatgtgcaggcccctgacccaatggccagctacaggcctggcgccaacaattccatggtgcgcctgtcttttggcgaaggccgggtgttctggagagatctgcctagcctgctgccagactccgccgcagcaggctctaagagggcagccgtgctggactgggcaagcaacctgcgctccatcggagcagatgcacctagctccatgctgctggtggcaggactggcaagcgatcaggccaagctgctgagatggaggtccgagaccgtggtgctgccagccgccctgctggactctgagggatgcgcaaacgagctgcggagatgtatccgggagagcgaggatctgtatggcgagctgagaaagatcgcagtggcaatgctggcagaggccctgcccgatcctgcatctaaggacacctgggcaagggcacggaccagcttcgacaatggaccagcagcagcaacatacttcgcactgctggagaggtccctgccttctctgatggccctgatcggcggcgatcgcctggagatgctggacgaggcagaggccttctggagatctaggctgctggccgccctggaggtggcatggcagggcgtgcgggagggactgggcctgagcgtggccgccctgagagcagaggcaaaggtgcgcccaaggtacctggccctgctgaggcgctatcggagcgagagaacctctagcacacccctggccgaggagcagtgcgcctga

SEQ ID NO: 1253 - DNA, 5562 bp, Lachnospiraceae bacterium KH1T2
atgggccccaagaagaagagaaaggtaggcagcggcatgagcaattccaagtaccagtttctgaacggcaagaagctggccgagttccacatgctgaagctgtatcctagctccgccctgaacagagacgatgccggcgagcagaagaccggcatgtataatggcacactgaggaacagaatctctagccagtgcatcaagcggtcttggagactgagcgagacctttgaggacgtgttcgatgagatcggcatcaggacaaagcgcatgccagagtacgtgggcaagaagctggtggagaatggcgtgcccgaggaggatgtgatctcttttaagaagatcctgagcggcgagaaggtggacgagaagtcctctaagaagtccaaggccgaccaggccatcgatgagggcaagcctgtgaagaccgccgccctgagcttctactccgtggaggagctggataagatcgccgagatctgcaagaggatctatgacgatctggaggagccaaagtccaagaatctgaagacaatcaagatcgacaacatccagaaggagatgcgcaagtgcgtgcaccccatgaatatcgatgtggccgcctttggcaggatggtgaccgacaacatgctgaggcctgtggagggagcaatgcaggtggcccaggccctgtctacaaatgccgccgtgaaggagaacgattatttcgtggcctgcgacgatctggtgaagggagagaccatcgaggacgtgggaggagagatgctgggcgacatcgattacaatagcgcctgctactatatccacgccaacgccgatctggagcagtttgccgagaatctgaaggactgtgagaacatggaggagatcgtgaaggccctgccatctaatatggtggaagtgatggcctacaccgaccccacagccaggcagagcaccatggaggcccacgtgctgcccgaagtgatctacgtggagctgaagagcaagaagcggccactgaacagaatgaaggccttcgccgagccctgtaaccgcaatatcgccgagaagtccgccaagaagctggccgattacatcaattgcaccaacgagaaggccgacctgggcatcacaaatgccctgtggtattgtgaggatgagagcgtgaaggccccagagaatgtgaccgtggtgaactccatcaaggagctggagcagaagctgaatgagtggatgaacgagggctccggcgagggaaggggctctctgctgacatgcggcgacgtggaggagaaccctggacctccgaaaaaaaagcggaaagtgggctccggcatgatccaggaggcctacgagaagctggcccacgaggagaagcggctgtttgcccactgtgccggcaagctgatcaaggacgccccaaaggccatcatccccttctacaaggtggtgccctccgagatcgagtctaaaaacggcaagaagtataccgtggacgaggatgccttctttgccgccctgtgcgtgaggtgtctgtttgagaagatcgagggcgtgacactggagcccgatatcctgatcagcgagggccgcaagaatcctaagatctccctggagggctatgaccggagaatcagcgccctgatgtccaacaccgaggccgagttctttatccctaagctggccaagctgatgaattacaccctgaagatcacatccaacaagatcccagactgcgatcagctgtattgggatatccacaatatcggctctaacgagaaggacgtgcagaggcgctgggcaaggaccatctacgtgaacaatgaggagggcagcggcgagggaagaggctccctgctgacatgtggcgatgtggaagaaaaccctggacctccaaagaagaaaagaaaagtcggcagcggcatgaagatcaagatcgtgctggagggagcattccaggcctggggagtgccttccgagtatacctggcggggcacatcttactatccaaccgccagaggcatcgtgggcctgatcggctgctgtatgggcatccctaggggcgacgatcgcctggagcagctgctgtccgtgctgaagatcacctacgacatcaacgaggacgataacggcaatcggaagtctggcagcatcctgacagattttcaggtggtgagaaaggaggacggaggcaagctgaatgcagcaaacggaggaaccggcgatagctacggcatcatcctgcacaagtcttatatcaatgacgccagcttcacagtgcacatcgagggccctgacgatctgatgaaggacgtgtacgatgccatgctggaccccgtgtgggtgccttatctgggcagaaagaattgccctccaaccgagccactgatccccgagattgaaggctccggcgaaggcagaggctctctgctgacctgtggcgacgtggaagaaaaccctggacctcctaaaaagaaacgaaaggtaggctccggcatgtacctgaccaagctggagctgaatatccagaacaaggccgtgctgcacaatatgtctaactgcgagtggatgcacaagctgatcctggagaagggctttggccacatccaggccgagaatgcccggcagacactgaagatcctgtacgccgtggatggcatcaaggtgtatgtgcagtccgccgtggagcccaagttcgagaactgttcttactggatcagcacccctgccacaatctgcatcgacgccatgaagaagatctgtggcaccggcatggccgtgcactttaagtgcacctgtaaccccacaaagaagctgatcgatggcggcaagagaatcttcctgagctccgagcgggagagagacgagtggatcaagagagtgatggagagaagcggcgccgaggtgctggtggagtctcagaccagcgatttcacagtgtggggcatgaagaaggacaagaagaccgataagtcccacaagatctacgccaaggccgtgacctattctggcgccctgaagatcacagacgaggagaagttttgggaggccttctgcaatggcatcggccgggagaaggcctacggctgtggcatgctgatgatccaagtcggcagcggcgaagggaggggctccctgctgacctgcggcgacgtggaagaaaaccctggacctcccaagaaaaagaggaaagtgggtggcagccagctggtgaagtccgagctggaggagaagaagtccgagctgagacacaagctgaagtacgtgcctcacgagtatatcgagctgatcgagatcgcccggaacccaacccaggatagaatcctggagatgaaagtgatggagttctttatgaaggtgtacggctataggggagagcacctgggaggcagccggaagcctgacggcgccatctacaccgtgggcagcccaatcgattatggcgtgatcgtggacacaaaggcctacagcggcggctataatctgcctatcggccaggccgacgagatgcagaggtacgtggaggagaatcagacccgcaacaagcacatcaaccctaatgagtggtggaaggtgtatccatctagcgtgacagagttcaagtttctgttcgtgagcggccacttcaagggcaattacaaggcccagctgaccagactgaaccacatcacaaactgcaatggagccgtgctgtccgtggaggagctgctgatcggcggcgagatgatcaaggcaggcaccctgacactggaggaggtgcggagaaagtttaacaatggcgagatcaacttctctgctagcgagacacctggcacctccgagtctgccaccccagagtccggcggctctggctctagcggcggctctggctcctccggaggaatgtgcgatcagcagtacgtgtctacactgaatgtgctgaaggacccttggattcccgtggtgtttctggacggcaagatcaaggatgtgggcatcatcgagtgtttcagaaacgccgagaagatcaagaccatctctaacagcaagccatatgagaagatcgccatcctgagatttctgaccgccttcatcacagacgtgtaccagctggataggcgcatcgagaggcagaagctgtatgacgccggctctttcgagatcgagcgcatcgagaattacgtgaaggagtgcgaggagaagaacggcgccagctttgtgctgggcgatagccagcggtccttcttttgtttcaactacaatccccaggtggacaccgagggagtgaagctgagcgccgcctatctgcacctggagctgcctcacggcaacaatccaatccacatcgtggcccagagggaggaggactttgagggcgatacactgccacagttcctgagggccgccctggcctttaatctgttccctaccggcaacatgctgaagggcgccaattctaagacaggcgacaactgctacatcgatggcgtgggcaaggacggcaagcctaagtacaccgccgcctatggcagcatgggcatcaatgcaggctctagcatggcagcagcagagcccgtgttcttttggcctgagtgcgataacctgtttcacacactggtcatgtgcatgaggtcccagggcgagctgcagaacaatctgaagctgaacgatcctccagccttctggaatgcagacgcagagccaaaccctaaggcaggcaagaggggcgacatcgtgaccagcgtgagcttcgtgagcggcctggcattccaggcaaggagaatcgtgccagtgatcgagaatggcaaggtgtacgagtgttatatctctaacggctacacaaacagcaatgagaacgtgtggcacgatccatttgccgtgaggctgcgcaaccacaagtccggcgagatcttccagatgccagcaaagggcgacagggagatgtggcgcaatatcggcaacctgaccgcctccagggaggagtcttggcacctgatgccagatgtgctgcgccccatcaagaagagcgccgacgccacagattactatgagaatatctcctctctggccatgatcccaatgacccagaacgccggctacagcgccatgttctatgacgatacagtgcagatccccaaggagtacctggaggattcctacctgggcgagtatctgaccacaaggatggagatcgtggaggagatctctaagatgtgggacaagctgaagatcagcgccctgctggacaataaggataagttttccggccactacagggacgatgccctgcaggagtattgggtgaagatccaccagtttctgttcgacggcgacgattctttcctgaaccacgtgatcagaatgtaccacgaggatagctcctcttttgagaagaccgccgacaaggccctgttcgagtatctgacaaagagcgtgaaggagatctgcgagaaggaggagaagaataccaactcctggaatatgctggtgaagatcatccgccagatccacggcaagaacggctgtctgcacatcttctacggcaccctgaagaagtattggaagaaggagggcaaggacaagaacgatacaggcagcatctga

SEQ ID NO: 1254 - DNA, 5565 bp, Klebsiella pneumoniae strain VRCO0172
atgggccccaagaagaagagaaaggtaggctctggcatgaccacacccttccgcaacacccggatcgagtttcacatcctgcagagcttccctgtgacatgcctgaatagagacgatgtgggagcaccaaagtctgccatcgtgggaggcgtgagccgggccagagtgagctcccagtgttggaagagacaggtgaggctggccctgcctgactttggcatcagactgggcgtgaggtctaagaagaccgccagcctgctggcaaacgcctgccgggccctgggagccagcgaggagcaggccaccggctgtggcgaggccatggccgccttcttttctgacgatacactgctgtttctgagcgaggcagaggcagcagccttcgccgcctacgcccagggcaaggattttgacgccgccagcctgaaggacaaggagctggtgaaggtggccaagaaggtggtgaacaataccctggatgccctggacatcgccctgttcggcagaatggtggccaaggcagcagatatgaacgtggaggcagcagcctcctttgcccacgcaatctccacacacaaggtgtctaatgagatcgagttctttaccgccgtggacgattgcaagacagaggacgagtccggctctgcccacatgggcagcctggagttcaactccgccacctactatagatacgtgtccctggatctgggacagctggcacagaccctgggagaggatgccgacatgaagacagccgtggccgcctttgtgaaggccctgtacgtggcagtgccatccgccagacagaccacacagtctggcgcctgtccttgggagtatgcccgcgtgctgctgcggaagggacagggactgcaggccagcttcgagcagcctgtgaagtcccagggcgagggctttctgagcccatccaaggccgccctgaagaattggctgcacaccaaggagaagctgtctggcagcctgttcggcaagcagggcgactacgagtggggcgaggatctggactatagcatcgatcgcctgatcgcagacctgcagtcccacctgggctctggcgagggaaggggctccctgctgacctgcggcgatgtggaggagaaccctggacctccgaaaaaaaagcggaaagtgggcagcggcatggatcaggtgcctgcagacgtgacagcagagtctgccggcaatgagagcccagccaagcggttcgtgggctatgtgatcgagcggatcgccaaggataacggatttgcagcacgcctgaagagggcagacaatccagccaccgagtatcagtcctgggagatcctggccggcttcggcatcgacctggagaaggagtggcagcgcctgccatactgcgtgatcggagccgccctggcaaaggcaaagcctgcctctaacggaaccatcacactgggagcagcaatcgcaggatgttaccccgagggcaatcagagcgagcaggcaaaggcaaggctgcggagactgctggcatgcacctccacatctgaggcctgtagaatcctgaggccactgctggccctgatggcaagccgctccgtgacccccgacttcgcaggactgctgaacgagctgcagtggtttagcggctctagcagggagcgcatccgggcaagatgggcacaggagttttataggagggcaggagaggcagcaggctctgaggccagaaacagccacgacggctccggcgagggaaggggcagcctgctgacatgtggcgatgtggaggagaaccctggacctccaaagaagaaaagaaaagtcggcagcggcatgaggcagaccacacagtacatgctgctgtggctggagggaccactgcagtcctggggaggcgactctaagtttggcgtgagagataccctgaatttccctacaaggtccggcatcctgggcctgatctgctgtgcaaggggagcagcaggccctgaggtggagtggctggccgagatgaacaatctgccaatggaggtgagagcctatgccaggaccgacaaggagggacagcctctgctgagggagccaacactgtgcgatttccagatggtgggcagcggctacgacgattccgacccctggcagtctctgctgatccctaagaccagcgatggcaagaaggcagtgggaggaggaaccaagatgacatacaggcactatctgcaggatgccgtgtttgcagtggtcatgggactgggcagccagcaggcagagtccctgcctgaggccctgcagaacccagtgtgggacctgtacctgggccggaagtcttgcgtgcctagcgagctgatctaccagggcatctatgattccgccgaggcagcatggcagcaggcaagaaccctggccgagagcaagcggagaacactgtcctataaagtgatcgagggcgagggcgatggcgacgtgatcaccctgaacgacgtgcctgtgcagttcggccgccacaagaggtaccgcgataggcaggtcaccgtgctggagtgcggaggctctggcgaaggcagaggcagcctgctgacctgtggcgacgtggaggagaatccaggaccccctaaaaagaaacgaaaggtaggctccggcatgaccgatctgtttgcatctgccctgcacctggacagggcagcagtgaaggccctgaagatctccgatgcctactctctgcaccgggtggtgtatagcctgttcgcagatgcaaggacagacagggagaagtgctcccacatctcctctggcatcgcatacgcagatcagggaggcgactttcacggacgcaagatcctgatcgtgagcgacaggctgccagcagcaaaggtggatggactgtacggcgaagtgatctctaagagcatccctgccgcctttctgtcccacagccggtataggttccaggtgcaagtgaatccagtgaggaaggacaagcagaccggcaagagagtggccgtgaagggcagggccgatatcgcacagtggttcatccagagggcagcatcccggtggggctttgatgtggacctgccaggactgcaggtggaggcaatggaggtgctgcagttcaaggacaagggaggccgccaggtgaccctgggcaaggcaacagtgcagggactgctgaccgtgacagatagacagaagtttcagcactctttccaccacggaatcggcaagggaagggccttcggctgcggactgctgcagatcgtgccagtggtggacgccctgtttagcggctccggcgaaggcaggggcagcctgctgacttgcggcgatgtggaagaaaaccctggacctcccaagaaaaagaggaaagtgggtggctctcagctggtgaagagcgagctggaggagaagaagtccgagctgcgccacaagctgaagtacgtgccacacgagtatatcgagctgatcgagatcgcccgcaatcccacacaggacagaatcctggagatgaaagtgatggagttctttatgaaggtgtacggctatagaggagagcacctgggaggctccaggaagccagatggagccatctacaccgtgggctctcccatcgattatggcgtgatcgtggacacaaaggcctacagcggcggctataacctgccaatcggacaggcagacgagatgcagcggtacgtggaggagaaccagacccggaataagcacatcaacccaaatgagtggtggaaggtgtatcccagctccgtgacagagttcaagtttctgttcgtgtccggccacttcaagggcaactacaaggcccagctgaccaggctgaatcacatcacaaactgcaatggcgccgtgctgtctgtggaggagctgctgatcggcggcgagatgatcaaggccggcaccctgacactggaggaggtgaggcgcaagtttaacaatggcgagatcaacttctctgctagcgagacacctggcacctccgagtctgccaccccagagtccggcggctctggctctagcggcggctctggctcctccggaggaatggagaacaggttcaatctgatcgacgagccctggatcgccgtggtggatgtgggcctggtgtccctgaccgacatcttttctcagccagagctgcgcgccctgggaggaaatcctgtggagaagatcgccctgacaaagctgctgctggcaatcgcacaggcagcagcaacccctacagacgattccgactggcagcagatgggatggcagggaatggcacactgctgtctgcagtacctggccaagtggcacgatcggttctacctgtatggcgagaagcccttcctgcagatgcctgccatccaggcagcagagtgcaagtccctgggcgtgctgagccctgaggtgtccaccggcaacaccacagtgctgacagagtctcagcagcagcagcagctgaccgatgccgacaaggccctggccatcgtgatgcagatgggcttcggcctgggcggcaagaagaccgacaacagcgtggtgctgacacccggctatcggggcaagcagaatgataagggcaagcctggcagcggcaaggcaggcgtgtccgtgggacacatgggcctgctgcactccttctggcagggcaactctatcgtgcagagcatctggctgaatctgtttaccgccgaggacatcacacagctggccatgtacccaaccctgggcacagccccatgggagagaatgcccaccggcgaggacgatgacatcgccagatccctgaaggcctctctgctgggcaggctgatcctgatgggcaagttctgtctgctggccgaggatggcatccactacagcgacggcatctcccacgccggctatctggagggcaagaccgatcccagcgtgtccgtggacttcagcggcaagaagcctaaggccctgtgggtgaatccaggcaagagaccctggagggagctgacatctctgctgcagtttatcgagcaggacagcccacgcggctatgagacccggcagctgagcctgcccctgaagagaatcacacaccacgcagagcagtttgcactgtggtccggcggactgagggtgagctccaacgcaggagagcagtacgccagcggcaccgatgactatgtgcagtccgagatctggctgtctagcgacctgatcaatcacaccttcctggagtacctgaagtatgagatgacacagctggatgcagtgcagaagcagctgtggggagcagtggtgcgctactttcggcagctgtccgatatcgacaagtctgccacaggcaaggcacagcccttcgtggcaaagcaggcagagaaggccaccacaatcttttggcagctgtgcgagaggcaggcacagaccctgatcaacgcctgtctgaatagcggcgaggaccacacagccagactgcagctgaggaagatctttgccagatatgccggccaggtgttcgatcagctgtgccctgccgactccgccaggcagctggatgcctgggcactggcccggccaaacttctctcagtacctgaccctggattga

SEQ ID NO: 1255 - DNA, 5769 bp, Streptococcus thermophilus strain ND07
atgggccccaagaagaagagaaaggtaggcagcggcatgaccacagagcagagactgtttctggacatccacgccatccagagcctgcccccttccaacatgaatcgggacgataccggctcccctaagacagcccagtatggcggcgtgcggagatctagggtgagctcccaggcctggaagaaggccatgcgcgagtacttcaacacccacggcgatcacagcaatgtgggcatcaggacaaaggagatcgtgcgctatgtggccgacaagatcgtggagctggattctagcatctccatcgaggacgccctggagaaggccgataaggtgctgatcgccgccggcatcaagaagaagggcgaggtgaaggccctgtacttcatgggcgattcccaggccaagaagctggcacaggcagcatacgacaacatcacccacaagaaggagctgcagaagctggccaatgaggaccccgccatcgatatcgccctgttcggaaggatggtggcagaggaccctaccctgaacgaggattcctctagccaggtggcacacgcaatcagcacccacccagtgcagacagagtttgatttctttaccgcagtggacgatctggcccccgaggacaatgcaggagcaggaatgctgggaaccgtggagttcaactcctctacactgtaccggtatgccaatgtggccatccacgagctgtctaagcagctgggcaacaaggagagcctggagaattctctgagcctgtttatcgaggccttcgccaagtccctgcctaccggcaaggtgaacacatttgccaatcagacactgccacagaccctgatcgtgacagtgaggtccgaccgcccagtgaacctggtgtctgccttcgaggagcccgtgaagagcatcgagggctatgtgaccaagtccatcgataagctggccaaggagtttatcaaggtggagaagttcgtggacaagcccctgatgaccttttacgtgacactgcacgagtccgattctctgaagcagatcggcgaggagaaggatagcgtgtccaagctgctggaggacttcagcgagatgatcgcacagtacatcggctctggcgagggaaggggcagcctgctgacctgcggcgacgtggaggagaaccctggacctccgaaaaaaaagcggaaagtgggctccggcatgtctcagcacaccaagcagacagtgtggaccgtgacaaagaagatcatcttcaagctgtccaatcagaaggaggagacctacgataaggccacactggccaaggtgcgcaagaccctgggcaagcctctgtctgaggccacagagatctggcctatcctgtttgagaacctgccagaggagttcctgagctcctaccagcagccatcctatgaggagctggccatctacaccgccctgcagctgtatgccctgcaccagcagggcgtgtctacaagcgtgatgctggacgattctaagccttatgagaacatcggcagcgccctgggcaagctgcgcaaggaggacgataccacaagcatcgacaggcgctttaataccatgatcacatctagcaccttcgaggagctgacctaccacctgcggcacctgatctccctgctgaaggtggagtctccagtgatccaggtggactactccggcctggccaacgatctgtattggttcctgaacaattctcaggagaacgtgaggctgaattgggcccgcgcctactataagcagatcaagggcgagaagaacaatgacaacggcagcggcgagggaaggggctccctgctgacctgtggcgatgtggaggagaaccctggacctccaaagaagaaaagaaaagtcggcagcggcatgaagaccatcctgctgaagtttgcaggacctctgcagtcctggggcacatcctctcactttgagacaagacacaccgacttctatccatccaagtctgccgtgatcggactgctggcagccagcctgggataccggagagacgaggatgagaagatccagaagctgaatgagctggacttcgccgtgcgggtggatcagcagggcaacctgctgagagactttcacgtggcccagaagtacaccgagaagggcaagttcgatcggaactatgtgacaaatagatactatctggaggacgccgtgtttgtggtggccctgtcccacaccgacgattctttcatcgatatcatcaagggcgccctgaagaacccctactttcagcctttcatgggcaggcgcgccctgcctatcaccgcagactttatcctgggcgagacagatgtgaatccactggagagcctgaagtccctgaagtggcaggcctctctgtggttcatgaagaagagccacgacaaggatgccatctccctggaggtgtacctggactctcagctggtgaacaaggacgtgtaccagctgcggcaggactacgtgcggagcttcagccagaagggccggagattcggctttaggtacgaggtgcgcgagctgatctccgtgcagaaccctcactatctgaacaagaataccgagcacaatatcttcgagagcatcggcgacggctccggcgaaggcaggggcagcctgctgacatgcggcgatgtggaggagaaccctggacctcctaaaaagaaacgaaaggtaggctctggcatgtacatcagcagggtggagatcgatcgctataataggaggaaggtgcgcgacctgacccacgtgggagcatatcacgcctgggtggaggagtcttttccaagcgagctggagcagtctatcaggacacgcaagctgtggcggatcgacagaatccagggcaaggattacctgatcatcgtgagcaaggagaagcccaatctgcagaagctggagaagtacggagtggtgggcagcgcccagactaaggactatcagcacttcctggattccatcaagacaggctttcggatgaacttcagaatcgtgctgaatcccgtgatctccatcacctctcctgacaagagcaagcggggcgtggtgaagccccacgtgacaatcaagcaccagatggattttctggtgaagcagtctgagaagaacggctttagcctggtgggcgagtctttcagcatcgtggagaggggctatgaggtgttccagaagcctgagaagccaatccgcctgtctaaggtggtgtacgagggcaccctgacagtgagcgacgataccctgtttaagaagatgctgacagagggcgtgggcaagaagaaggcctacggcttcggcctgatgaccgtggtgcccctggaggagggctccggcgagggcaggggctctctgctgacatgtggcgacgtggaagagaaccctggacctcccaagaaaaagaggaaagtgggtggctcccagctggtgaagtctgagctggaggagaagaagtccgagctgcggcacaagctgaagtacgtgccccacgagtatatcgagctgatcgagatcgccaggaaccctacccaggaccgcatcctggagatgaaagtgatggagttctttatgaaggtgtacggctataggggagagcacctgggaggcagccggaagcctgatggagccatctacaccgtgggcagcccaatcgactatggcgtgatcgtggatacaaaggcctacagcggcggctataacctgcccatcggccaggccgacgagatgcagaggtacgtggaggagaaccagacccgcaataagcacatcaaccctaatgagtggtggaaggtgtatccaagctccgtgacagagttcaagtttctgttcgtgtctggccacttcaagggcaactacaaggcccagctgaccagactgaatcacatcacaaactgtaatggagccgtgctgagcgtggaggagctgctgatcggcggcgagatgatcaaggcaggcaccctgacactggaggaggtgcggagaaagtttaacaatggcgagatcaacttctctgctagcgagacacctggcacctccgagtctgccaccccagagtccggcggctctggctctagcggcggctctggctcctccggaggaatgtccaggttcaacctgctggatgagccatggatctccgtgatctatgacgagaagggcagcaccaaggacgtgtccctgcaggatctgtttacaaatgcccaccagtacaaggagctggccggcgacaccaagacacaggatttcgccgtgctgcgggtgctgctggccgtgctgcacaccgtgtttagcagattcgacatcgatggcaacgcctacgagtatctgacaatcgacgagggctggaatcagctggagcctgtggacgagatggatatcgagaactacgaggaggccctgtatgagacctgggagaagctgtggacaaataagcggttcccaaacatcgtgaatcagtacctggagaagtggcgggaccggttctacctgttcgatcagaagtatcccttctttcaggtgaccaaggaggacatcgccggcgataagatcagcaaggccaagggcacatccatcctgggcaagaacatcaatagaatcatctctgagagcggcaacaagatcgccctgttctccccaaaggacgaggagaacaagaataccctgacagcagcagagctggcaaggtggctgatcacctttcagggctactctggcgtgagcgacaaagtgatcttcggcaacgagaagtatacacccagcaagggctggctgtttgatatcggcgccatctacatcaagggcaataccctgttcgagacactgctgctgaactacatctccccatataatgagtgcggcaacgtggagaatatccagcggccctgttgggagagaaagagctccgatatcatcaagtcttacctggacgagaaggatatcaccaatatcgcctctctgtacacagtgtggagcaagggcatctatatcgaccccgacttcaacctgaataagcccttttccttcgacatcgtgaagctgccagacatcaaccacagggataatttcctggagcccatgaccctgtggaagtacaacgtgtccggcaagaatcgcgattcttatacacccaagaagcacctgctgaaccagtctctgtggaggagctttggcctgctgagcatcaaggacaccgatctgcagcaccgcaagcctggcgtgatcgagtggctgacatacatcgacgatatcatcggcaaccggctgagcaatatcgtggccatctccatgcaggacgatggcaatccacagagcagactgcccaccgacgaagtgatcgattccatcttcatcaacgacctggtgctgacagacctggatgagggcggctgggtgcccagaatcaatgaggtggtggaggagaccaagaagatcatctcccggacatacaagacctatatcaacgatatcaaggagatcagaaacatctccaatggctcttacacccagcagatcgtggagagcctgtacttcaagatcgaccagcccttcagacagtggctggcctccatccagcctgaggacgataaggattctaagatccaggagtggagggtgctgctgaagaagatcgtgaaggccgaggcagaagtgatcctgcaccagggaggagccagggattatctgggcatccagaaggacggccgcatcaagaacatcgccaccgcctacaatagctttgacttctggctgaggcagcagctgaagtga

SEQ ID NO: 1256 - DNA, 6294 bp, Streptomyces sp. S4
atgggccccaagaagaagagaaaggtaggcagcggcatgtcccagccagcagcaaggccacctagaacatacgtggactttcacatcctgcagaccgtgccacccgccaacctgaatcgggacgatcagggcaacccaaaggaggcctactatggcggcgtgcggagatccagagtgagctcccaggcctggaagagggcaacccgcacacacttcgcagagcgggtgcccgagcaggatctggcaaccagaacaaggaggatcatcggcgccctggcagacgatatccagaagagggccggcctggataggcctgccgccctgaggctggcagacgccctgctggccccactggagctgtccggcggcaagaagaaggacgagtctgcctacctgctgttttatggccggagacagctggatgcagtggccgccctggtggcagaccaggcaaccgagctgtctgccctgagcgatgcagacctggcatcccgggtgaaggagctgcccgtgagagagcagttttctacaggccaccctatcgacgtggccctgttcggcaggatggtggccgacatccctgccctgaaggtggatgcagcagcacaggtggcacacgccctgagcacacacgccgtggagctggagtttgattacttcaccgccgtggacgatgagcagacagacgaggagaccggagcaggaatgatcggaaccatcggcttcaacagcgccacactgtaccgctatgcctccgtgggactgcaccagctgctggacaatctgaccgatgaggaggccgccctgacagccatctccgagtttgccacctccttcgcccggtctatgcccacaggctatcagaactcttttgcccacaggaccctgcccagcctggtggcagtggtggtgcgcgaggaccagcctgtgaatctggtgagcgccttcgagcagccagtggccacaccatccggcatcgcagcagcatctgccgcaaggctggccgaggagcacacccgcgcaaccgtgacatggggcgatgcaccagcctttgccgcagcaacacacgtgttcaccgaccaccagaagaccacagccgccctgaacagcgcctttggccctagcatcccattctccgccctgctggagggactgcacacccacctggcaggcgccctgaagcctaagcaggcagcacagggcagcggcgagggaaggggctccctgctgacctgcggcgacgtggaggagaaccctggacctccgaaaaaaaagcggaaagtgggctccggcatgtccacatctccactgtctgcccccgtgcctggccagagagtgtctagcctgccaaggccatactggtccggcagggcagatgagcagggacagtggcggaccagagcaggagagagcctgaggccacctggagaggacctgtccgccctgagagcaggactgggcaagaaggccttcacagagccaaggctgtggcagtactataccacacccacagatggccgcgtgaccctggagctggaggcagagcacgccgccctggccctgtacggactgcaccagcagagccaggagcagccaatgcacaggcagggcgtgcggaccggaagagccctgagggccctgcaccagcggtactctgaggaggcaacagacaggcgcgtggcacaggcagtgggagccaccagcgccgcagcctttgcctataggctgcgcgccctggtgacccagctgaggtctatcggccagccactggattacgaccagctgatgcaggatctgctgaggtggcacttccccgacggccggagcagagtgcggagaggatggggactgggataccacggaagggacaggcagcccgatgaggccccaccccctgagggcagcggctccggcgaaggcagaggctccctgctgacttgtggcgacgtggaagagaaccctggacctccaaagaagaaaagaaaagtcggctctggcatgaccacagcacctacaccagagccagcaggaaatacccacccagcacacggctccgatgagcctaccgtgctgctgctgaggctggcaggaccactgcagtcttggggcgtgagatcctcttttaacaggagggacacaggagcagagccaaccaagtccggcgtgatcggactgctggcagcagcagcaggacaccctagagagcagccactgggagagctggcagatctgaccctgggcatcagggtggaccagccaggcacactgctgagggactaccacaccgtgagcgattataggggcagacctctgccacaggcaggcgtgtctgccaagggcatccagaagcccaccagccctgccaagcacacacacgtgaccacaaggttttacctgcaggatgccgtgttcgtggccgccctggagggacctccaggactgctgaccacactggacagggccgtgcggaatccagcattcccactggccctgggccggagaagctgtccacctacccagccactgtccctgggactgcggaccacagatatggagacagccctgagatctgagccttggcaggccagcgcccacaccagagagcagtatgcaaggcgcctgggaagggagaggggactgcaccagcctctgcacccaggaaccatcgacagggcagcaacaatcgaggaccccaggggcgacgataggctgcaggacgcacccgtgagctttgatcctcaccagagggccttcacctccagacaggtgaggcacacctggctggccatccccacaggctttgaccacatcgacgatgaccagcctcacggacaggcagatgaccccgatcacgaccctttcgccctgctgggatggggctccggcgagggcaggggctctctgctgacctgcggcgatgtggaggagaaccctggacctcctaaaaagaaacgaaaggtaggcagcggcatgacatacctgtcccggatcagaatcaacccactgcggaaggacagccggaagctgctgagcaatccaagggcagtgcacggagccgtgatgggaggcctgccaaaccacaagcccgatgacagggtgctgtggcgcatggaccccgacaatcctcacaggccacacctgtttgtgctgagccccacacgccctgactggacccacatcatccaggattgtggctggccagatgcagacggcgatcacgcagccgtgagagactataccccactgctgagccagctggcagtgggaagagagttcgcctttaggctgacagcctcccccgtgcagaacaccgccacaccaaccaaggcaaccccagcacaggcagcaaggctgaccacacacgccgagaatggcaagcggatcagaggcttcagaatgggacacagaaccgcagcagcacagctggattggtttctgacacgcaccgaccggtggggcttcgatatccctgcaacaagatctgacccagcagcaccaggcatccacgcaccaacacctccaaccgcaccaaggcctacaagcccacctagaccagatcccaacccaccatacgaggtgcgcatcaccgcaaggcacagacactcctttcagaagaatggccacggcgcccacgtggtgtttcggtctgccaccttcgagggcaggctgcgcatcacagacaccgatcggttcaccacatctctgctgacaggcctgggccctagcagagcctatggatgcggactgctgacactggcacctctgccaggacagcagaccggctctggcgagggaaggggcagcctgctgacctgtggcgacgtggaggagaaccctggacctcccaagaaaaagaggaaagtgggtggctcccagctggtgaagtctgagctggaggagaagaagtccgagctgaggcacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagccagacggcgccatctacacagtgggctcccccatcgactatggcgtgatcgtggataccaaggcctacagcggcggctataacctgccaatcggacaggcagacgagatgcagcggtatgtggaggagaaccagaccagaaataagcacatcaacccaaatgagtggtggaaggtgtaccccagctccgtgacagagttcaagtttctgttcgtgtccggccacttcaagggcaactataaggcccagctgacccggctgaatcacatcacaaactgcaatggcgccgtgctgtctgtggaggagctgctgatcggcggcgagatgatcaaggcaggcacactgaccctggaggaggtgcggagaaagtttaacaatggcgagatcaatttctctgctagcgagacacctggcacctccgagtctgccaccccagagtccggcggctctggctctagcggcggctctggctcctccggaggaatgcctggcaagggaggagcaagcgtgaacctgctgtccgatggctggctgagcgccgtgtccgccggcggcggcagcggctttggaggaggacctggagcaggaccagcagagttcggcgtgcgcgagctgctgctgaatgccgagaagtttgccgacatcgtggtggatctgccaacccagaggcctgccgtgttccggcaggtgctgctgcctctggtggtggacgccctgggatgtccaaaggacgcagaggcctggatggatatgtttagggcaggagccttctcccccgagcagaggcaggtgctggccgactacctggataagcaccagcacctgtttggactgctggaccccgtggagccattcggccaggtggccgacctgagaacagcaaagggagagaccaagggcagcgccctgctggtggcaacagcagccaccggcaacaatgtgcccctgtttagctcccggacagagggcgacgtgctggagctgacccctgcagaggcagcaagatggctgctgcacacacactgctgggataccgcagccatcaagacaggagcagtgggcgaccctatggtgaagagcggcaagaccaccggaaacccaacaggacctctgggacagctgggagtgaccatgccagtgggctccacactgttcgagaccctgctgctgaatatcccatacggacaggcaggactgtctgatgacgtgccacagtggaggcgccggagcacccagggcgacgtgaaggataccctgtcctgtgcaacacccgtgtggcagagccggccagcaaggggactgctggaggcctggacatggcaggccagaaggatcagactgatctcccaggacacagatcgcggcccaaggatcaccagagtgctggtggcagcaggcgacaggctggaggtgtctccagatacagagccccacaccgcatgggtggtggatagcccagcaggccggagaggcaagtctcctgcacggagcggcgtgaagtccgccagaccaagaaggcacaccgcaggaagggcaggatggaggggcctggacgccctgctggccgtgaacgccgtggaccaggatcagcaggcaacagcaacccggagcggcgccgtgtctagccagctggtgagacagctgtctgccatcagccgccggctgcctagccggtacccactgagagtggagctgaccggcatcgcctatggcaaccagtccgccgtgatcgaggacatgtacttcgatgagatcccactgcctgtggccgccctggaccccgagggcatcgtgtacggcgccctgctggaggtggtggaccaggccgaggatctggccaaggccgtgaatcacctgtccggcgacctgagaagggcagcaggctctgagccaatcccatgggacaagggacagaggcctggcgataccctgctgcacgccctggacccaatcgtgcgccggctgctggcaggactgaggcaggccggcgatgactttgataggtgtgagcagggcctggaggcctgggagcacaaggcaggacaggccacactgcgggtggcagagggcctgtttaatagcgccccagccgccctgttcaccggcagaagggtgaagaaggacggcaaggagcaggtgtatcgcctgtctacagcagaggccagcttccgccggagactggccgtgatcctgcacaggcgcgccgccgcccggaccgccggctga

SEQ ID NO: 1257 - DNA, 5103 bp, Campylobacter fetus subsp. testudinum Sp3
atgggccccaagaagaagagaaaggtaggctctggcatgaagctggccaaccgcatctacggcatcatcggcatcaagagcaccatggccaattggaacgccgacttttctggccgccccaagagcacaggcaatggcgacatcttcgccagcgataaggccctgaagtatcctatgaagaagatgtgggagtcctacggcaagaacatcctgttcgtgaagtccctgaagcagggcaagtctaaggacggcaacgataagctggtgccaaataccctgggcgagcggtatggcctgctgtttggcgatatcaagaaggccaagagcacaaaggaggtgctgtccaatctgttcaactgcatcgatgtgaagaattttggcgccaccttcccagaggacggctacaacctgagcatcacaggcgccgtgcagatcggccagggctttaacaagttcggcgacatcaacatcgaggtgcagaatatcctgtcccccttcgccgatagccgggccaaggagaagaatgagaacggagaggacgcctcccagtctaccctgggcacaaagatcgtgaccgatgaggcccactacttttatggcttctgtatcaaccccctggcctataatgactacaaggagatcctgggcgacgattttggctataatgaggacgattacgccgagttcaagaaggccgccagattctgcgccacctactttaatagcaactccaagtttggctgtgagaacgagtttgccatgttcatcgagacagccgtggacgcctatctgcctgatctgagctcctacatggacttcatctgcaaggataagaacaggctggtgaatctggagaagatcgagaagatgatcgagtctagcgatgtgaagaaggtggagatctactataatcctctgtccctggacgtggagaccaagtttgacaagttcgatatctattctggcaacaagatcggcagcggcgagggaaggggctccctgctgacatgtggcgacgtggaggagaaccctggacctcctaaaaagaaacgaaaggtaggcagcggcatggatgtgaagatctaccagctgaaggtgttcctgaagctgaatcagaacgtggacttcatcaacagcccagagtttctgtccaccaatctgcacaaggccatgctgggcgatgaggccctgaggtccatccacatgcagcggtacctgaagccctactctatcggctttctgtacagcatgaagggcaagaaggacacatttgtgagcggcgaggatatgtacttctatgtgcggtccatcgacgagtctttcatcagcaagctgagaatctgcctggagaattctaagaacctgggctttaacgtgtatctgagcaagttcgagaatctggacatcaagcaggtggataggctgtacaccatgagccctgccacaatcgtgctgaaggagggcgataagaccatcccatggcggagagagaactccgacatcacagtgctgaaggaggccctgatctctaatctgaagaacaagtacgagtatttcctggacaagaagatcgagatcaaggacgatatcatcgagctgatcgagatcaagaccaatcgggccttcgcctttagatataagaacggcaagatctacgcctataggtaccagatccactttagccagaaccgcctggcccaggagttcgccaatatcgccatgatcctgggcgtgggcgtgaagaataccctgggcttcggcttttgcatgaggtccaacaatgcagtgggctctggcgagggaaggggcagcctgctgacctgcggcgatgtggaggagaaccctggacctccaaagaagaaaagaaaagtcggctccggcatgaaggccatcagctttaagctgtccggcaagtttgcccacttcaagaagccagacgtgaacgagtacgtgtacttcacctacaacaatatccccaagcctacactgctgggactgctgggagcaatcatcggcctgaagggctatgcccagaagacctacaacaataagaaggacaagaagagcctgctgaacaatgagaatcggtccaacgagcctgagttctatgagagactgaagcacctgaagatctgcatcatcccactggtgaagtacggcaagttttctaagaagatccaggtgttcaacaattctgtgggatatgccagcaccgaggagggaggaaatctgatcgtgagggagcagtggctggagaaccccagctggcagatcctgatcgaggacgatggctctgccgagtttgagacaatcagccagtatctgttcgataagaaggccaagtttatcccttacctgggcaagaatgaccacttcgccgatatctccgaggtggagaagatcgacctggccgagtccaagaaggataagatcgtgatcaagtctctgttcctggacaacctggccaagcaggtggacgatcccgacgatgagatctcttatctgtttaacgagttctaccctatcggcttcaatgagctgatgttttacaagctggagaagaccaccttcaccaatcagatctgtcaggccatggatggcaagtggtatgagttcaaggacggcaccatctgcttctttggctccggcgaaggcaggggctctctgctgacatgtggcgatgtggaagaaaaccctggacctcccaagaaaaagaggaaagtgggcggctcccagctggtgaagtctgagctggaggagaagaagagcgagctgaggcacaagctgaagtatgtgccacacgagtatattgagctgatcgagatcgcccggaatcccacccaggatagaatcctggagatgaaagtgatggagttctttatgaaggtgtatggctacaggggcgagcacctgggaggctctcgcaagccagacggagccatctataccgtgggcagccctatcgactacggcgtgatcgtggatacaaaggcctattccggcggctacaacctgcctatcggccaggccgacgagatgcagcggtacgtggaggagaaccagaccagaaataagcacatcaatccaaacgagtggtggaaggtgtatccctcctctgtgacagagttcaagtttctgttcgtgtccggccacttcaagggcaattacaaggcccagctgacccggctgaaccacatcacaaattgcaacggcgccgtgctgtctgtggaggagctgctgatcggcggcgagatgatcaaggccggcaccctgacactggaggaggtgaggcgcaagtttaacaatggcgagatcaacttctctgctagcgagacacctggcacctccgagtctgccaccccagagtccggcggctctggctctagcggcggctctggctcctccggaggaatgctgttcgagctgctggatgagtttaagaagcagctggagaagaacaagcacatcgtgacacagaatcacatcctgaaggatggcgtgtatgcccgcatctccgacgagaagtgtgagatcttctacgtgaagaccatcacagagaagatcggcaagaccgcccagaagcggacaatcctgtataagcagaacggcgacatcgccctgaatgacgatatgcagtggtttgagcaggccgactacctgagcttcctgtgggatatgaacaaggccgtgctgcccaataagaagttccacagcatcaactttctgtccctgttctttaagctggaggagtccgagtacgtgaaggagaatctggaggagtattttgacatcttcagagattactccgcctttaacaaggccaaggataaggagatcctgtctttctatatggactacatcaaggatgagaataggcagaacctgatcaccaattctgtggtgctgagcaagaagtacttcaatgacatcaacgattttgccgtgcagaacaatttcaagaagtgctacatcaagttctttatcgacaaggatttcgagatctacgagaaggagagccagatctatatcgacctgaagatctacaattccaacgagcacaacatcaagtataacaatgagatcttcggcctgtctaacttcaacatgggcatgaatagcaagaagccatttctggagcacaagaaccgcctgttcaagatcccctacgccatctcccagaaggatgccctggcctctaagatgctgtttgactggctgggcagccagaacaagcggatcatcagagactttaattccatcttcatctctaagtttaacaagcagtctaaggccgtggtgagcgacttcgagtacgtgcccgtggataagaacaagtttaagttcgacaagttcaagctgaagaacttcatgaacatcgagaatggcgagaaggagatcctgagctttgacgatttcaagcaggtcatcgatgagcagctgtatcacaagtgcctgtttggcaacctgtacaatgatgagatcagggtgagcaagcgcatctccgaggacatgcagaatctgctgtatcagacccggtgttccatggtggagtactttgacaagttcaacaataacgagttctactatgtgatccagaagtactctaacgacttcatcaagatcgccatgcaggacagcgagttcggccgcctgaacggcaagaagagcatcaatctgctgctgtccatcaaggagatcaagggcgagaaggtggacatcgatggcatcaagaatagagtgatctccgccctgaccgacgataacgtgacaaagctgtctggcaatgagtactattttctggtgggcaacctggccatgtacctggtgagcaagtccaagacctggaagaagacattcgccctgaccgatccatatacaaaggcccggaacaccaagaagctgaagatggccctgtttatcgacttcgatagatataactacgacatctttctggagaatggcatcctgaagaaggccttcagcctggcccagaattgtgaggatatcgtgatgtccaataacgaccagcagatggtgctgatcggcatgatgacaaagaacatcatcaagaagcccggcgagaaggacgagatcagcgagtga

SEQ ID NO: 1258 - DNA, 5319 bp, Odoribacter splanchnicus DSM 20712
atgggccccaagaagaagagaaaggtaggctccggcatgtctaacaccttcaagaatcgggtgtttggctgcgtggtcatcaagagcgtgaactccaattataacgccgacttctcccaccagccacgcacactgcctgacggcagcgtgtacgccaccgataaggccctgaagtacacagtgcggaactatatcgacaagaattaccctgaggataaggtgttctactttaagtctctgaacggcgacatgcagccacgcgacctggatcagaattatgcccggttctttggcgactaccccaaggccgataagaaggaggccgtgaaggccagaaaagtgatcctgggcaacctgctgagctgtctggatgtgaggctgtttggcggcaccttcgcctctaagacagccaacctgagcatccacggagtggtgcagcctacccacggagtgaatagatatgtggagggcatcatctacagcgagcagatcgcctccccattcaggaattctaacgacaattctaccgatagcatgcagaccacactgggcacacagttcaagctgcaggagggccactacgtgcaccactttagcgtgaacccaggcaatctggacgagctgaccgagtttgtggataacggccgcctgacaggcgaggacatcgcaaagctgaaggaggccctgagatgcggagtgacctactatgatagctcctctaaggccggcacagagaacgaggccctgctgtgggtggagctgaaggaggagtccaagctggtgctgccctctttcgtggacctgatcgaagtgaatgccgagcgggagatcgattttgccaaggtgtctaccctgctgagcaaggagaagatcaagaacgagatctccaagatcgagctgttctacaataagggcatcaccaaagtgatccacctgcctgagggcacagtggagctggagctgaacggactgggcagcggcgagggaagaggctccctgctgacctgtggcgacgtggaggagaaccctggacctcctaaaaagaaacgaaaggtaggcagcggcatgaggctgaagctggtgctgaagatcgtggagggcacagtgctgccctgcaactatatgtacgagctgagctcctgtctgtacaaggtgctgaacgagggcaatcccgtgttcaccgcctggctgcacgataagggctattgcaaggagaagaaggcctttaagctgttcacattttccaatttctactttccatgtttcagaatcgagggcgacaggatctttgtgctggccgataccgcccagctgatcgtgtctttctaccccatcgaggccatcgacgccttcgtgatgggcctgtttaagaaccgccagctggaagtgggcgatcggaagtccagggtgcgctttgaggtgttcaatctggagaggcaggcagagcctgagttcaccagccggatgttctttaagacactgtccccaatgtttatcgaggagcagctgcccgagacaagaaaggccatccacctgtctcctggcaacccaaagttcgccgagctgctgcacctgaatctgctggacaagtacagagtgttttatggccaggagcccgatcctagctggccactgaccaggctgcacctgctgtccgagccaaagcccaagacaatcgtgctgaaggtcggcacccccgaggagacaagaatgaagggctataccttcaggtttgagctggagggccagcctgagctgctgagactgggatacgagggaggattcggcaggctgaacagccagggctttggctgcgtggaggtgctgaagcagggctctggcgagggaaggggcagcctgctgacatgcggcgacgtggaagagaaccctggacctccaaagaagaaaagaaaagtcggctccggcatgaacaatcagcggctgatctctttcgacatccaggccgattttggcttctttaagaagcctgactataacgatggcgtgctgctgacctacaatatgctgcacaagccagccctgctgggcatcctgggagccatcatcggcctgagaggctacaggaagaagggcgagtggcccgagtactatcagagactggccgccctgcctgtgggaatcgagccactggagggcaggcacgagaagggcaacttccagaagacaatcgtgaagtataccaatacagtgggctacgccaaccaggacggcaatctgctggtggaggagtctatgctgatccgccctgcctaccggtgctatctgctgctgagcgaggagcacccagatcaccgcaagctgtatgagtacatccgggagggctgggccgagtacatcccttatctgggcaagaacgagtatccagcctggtttggcgactccttccgcgagtacgcctttaagaccttcgtgcctgagacagatttccgggtgtctagcctgtttatcaaggagggcgtgctgaagggccagcaggtgaaggcctccttctcttttagcctgaagggcatcgtgaatagaggcagcttcgtgtacttcgagaggctgcccgtgggcttccaccctgtgctgatgcagtacgagctggccgacttcgcctttaccgattggacactgcaggccgccacccagatggtgaacctgtaccagctggaggaggagggcaagatcgtgcagctgtttggctccggcgaaggcagaggctctctgctgacatgtggcgacgtggaagaaaaccctggacctcccaagaaaaagaggaaagtgggcggcagccagctggtgaagtccgagctggaggagaagaagtccgagctgcgccacaagctgaagtatgtgccccacgagtacatcgagctgatcgagatcgccagaaaccctacccaggacagaatcctggagatgaaagtgatggagttctttatgaaggtgtatggatacaggggagagcacctgggaggctctcggaagccagatggagccatctataccgtgggcagccctatcgactacggcgtgatcgtggatacaaaggcctacagcggcggctataacctgccaatcggccaggccgatgagatgcagagatatgtggaggagaaccagaccaggaataagcacatcaaccccaatgagtggtggaaggtgtacccttcctctgtgacagagttcaagtttctgttcgtgagcggccacttcaagggcaactataaggcccagctgacccggctgaatcacatcacaaactgcaatggagccgtgctgtccgtggaggagctgctgatcggcggcgagatgatcaaggcaggcaccctgacactggaggaggtgcggagaaagttcaacaatggcgagatcaacttttctgctagcgagacacctggcacctccgagtctgccaccccagagtccggcggctctggctctagcggcggctctggctcctccggaggaatgctgcaggagatcaacaatttcatgaattctctgccagcagagctgaagcaggcaggcctgaagccaaaggagggactgcacgtgctgctgaagatccaggagaaggagggcacccactttatggacgagcagtccgtgtgccgggtgtgcctgacccggaaggcaacagagtttgattaccccttcctgcagcactgcgcagagctggcccaagtgggatggtgcgtgaacacaaataagtgtttcgacctgcctgccaagggcctgcactcttgcagcccatattgtatcgccctgaagagagagagcctggagggaggcggcaagtacgcaaaggacaagaccaagatctatgacaggatcgatacatactttgccaacgccctgagctacgtggaggaggattccgagaaggagcggatcagagtgtttcagcacttcatcaactccaaggagaagctgaatgccctgtttgcctgtttccagtctgaggtggacgaggtgaaggataaggagtacatcatcctgtatctggaggaggagatggagaagtataggcgcgtgcacgagaagtacctgtccgacaagctgttcaacaccaatgagtataacatcagcgtggagaatcagctgtacggcacctccgattttctgaacggcttcccaacaaagaagcccttcctgagccaccagtccgccgtgtttgacatcgcaggaaggatcaccggagagatggcaggcaacctgcacgattttcaggagatcatgcggagaaatgtgctgcctcgcccactgcccctgttcgtgtatcgggaggagctgcagacagagatgctggccgtgtttagcagatacctggccgacggcaagaggatcggctatcaggagatcatccgcgagctgtacaagaaccaccaggacgatatcggcgactactatctgctgtactattacggcgataccgtgtgcgactttgatttcgtgtctaggttccgctacaggctgcagagcggcgacaaggagggatggatggtgaaggatcactttcagatcggcttcaccgagaagatcagccacgtgttcgagctggaggagaaggtgctgcgggagatctttaacaattccctgatcaccagaacaaaggccggcgacacacagaggaagtatttcgatgagctggagcccaagtactgtaagtctgagaacaattatctgctggtgctgaagtacagacaggccttctatgactacatctataagagccgcctgcaggcagtgacccggcctatgtttgatcacatcctgctgacaggcatcctggaggacatcagactggatgagctgaagggcaaccagcacacccagaggtggggcatcctgtccaagatgaatatctggttctctctggccgagcggttcgacctgcagttcaagaacaccgatacaatggccagcaagctggaggagcagcgggtgttcatggtggccctgtcccagggagaggcaatcctggagaatgacgagcagtacgcctttgccgccggccaggtcatctactacctgctgcacaagtctaagaccgccgataagagctataagaggctggagcccttcctgcagcaggtgcacgcctccgagctgaacaaggccatcgcccgcctgtttgacacctacaagcacgagaacttttctggcaatttccggcacccatttgccagcgtgatggcctatcagacacaggccaatatgcgcgactacctgcccatgatgctggccggcatcttcagcgataacctgctgttttccgtgaataagtctgaggagaccaacgaggagaattga

SEQ ID NO: 1259 - DNA, 4341 bp, Bacillus halodurans C-125
atgggccccaagaagaagagaaaggtaggcagcggcatgaccatcctggatcacaagatcgacttcgccgtgatcctgtccgtgacaaaggccaatcctaacggcgacccactgaatggcaacaggcctcgccagaattacgatggccacggcgagatctctgacgtggccatcaagagaaagatcagaaacagactgctggatatggaggagcccatctttgtgcagagcgacgataggaaggccgactctttcaagagcctgagggatcgcgccgactccaatcctgagctggccaagatgctgaaggccaagaacgcctctgtggatgagtttgccaagatcgcctgccaggagtggatggacgtgcgctccttcggccaggtgttcgcctttaagggctccaatctgtctgtgggcgtgcggggacccgtgagcatccacaccgccacaagcatcgatccaatcgacatcgtgtctacccagatcacaaagagcgtgaactccgtgaccggcgataagagaagctccgacacaatgggcatgaagcacagggtggattttggcgtgtacgtgttcaagggctccatcaatacccagctggccgagaagaccggctttacaaacgaggacgccgagaagatcaagagagccctgatcacactgttcgagaacgattctagctccgccaggcctgacggctccatggaggtgcacaaggtgtattggtgggagcactctagcaagctgggccagtactcctctgccaaggtgcaccggagcctgaagatcgagtccaagaccgatacaccaaagagcttcgacgattacgccgtggagctgtatgagctggatggcctgggcgtggaagtgatcgacggacagggctccggcgagggaagaggctctctgctgacctgtggcgacgtggaggagaaccctggacctccaaagaagaaaagaaaagtcggcagcggcatgcggaacgaggtgcagtttgagctgttcggcgattacgccctgtttaccgaccccctgacaaagatcggcggcgagaagctgtcctactctgtgcctacctatcaggccctgaagggcatcgccgagtccatctattggaagccaacaatcgtgttcgtgatcgatgagctgagagtgatgaagcccatccagatggagtctaagggcgtgaggcctatcgagtatggcggcggcaacaccctggcccactacacatatctgaaggacgtgcactaccaggtgaaggcccacttcgagtttaatctgcacagacccgatctggcctttgacaggaacgagggcaagcactactctatcctgcagcgcagcctgaaggcaggaggccggagagacatcttcctgggagcaagggagtgccagggatatgtggccccttgtgagtttggctctggcgatggcttctacgacggccagggcaagtatcacctgggcaccatggtgcacggcttcaattacccagatgagacaggccagcaccagctggacgtgaggctgtggtccgccgtgatggagaacggctatatccagtttcctagaccagaggattgccccatcgtgaggcctgtgaaggagatggagccaaagatcttcaatcccgataacgtgcagagcgccgagcagctgctgcacgacctgggaggagagggcagcggcgagggaaggggctccctgctgacttgcggcgacgtggaagaaaaccctggacctcccaagaaaaagaggaaagtgggcggctcccagctggtgaagtctgagctggaggagaagaagtccgagctgagacacaagctgaagtacgtgccacacgagtatatcgagctgatcgagatcgccaggaaccccacccaggatcgcatcctggagatgaaagtgatggagttctttatgaaggtgtacggctataggggagagcacctgggaggctcccggaagccagacggcgccatctacaccgtgggctctcccatcgattatggcgtgatcgtggacacaaaggcctacagcggcggctataatctgcccatcggccaggccgacgagatgcagagatatgtggaggagaatcagaccaggaacaagcacatcaatcccaacgagtggtggaaggtgtaccctagctccgtgacagagttcaagtttctgttcgtgagcggccactttaagggcaattataaggcccagctgacccggctgaaccacatcacaaattgcaacggagccgtgctgtccgtggaggagctgctgatcggcggcgagatgatcaaggccggcaccctgacactggaggaggtgaggcgcaagtttaacaatggcgagatcaacttctctgctagcgagacacctggcacctccgagtctgccaccccagagtccggcggctctggctctagcggcggctctggctcctccggaggaatgagctggctgctgcacctgtacgagacatatgaggccaatctggatcaagtgggcaagaccgtgaagaagggcgaggacagagagtacacactgctgccaatctcccacaccacacagaacgcccacatcgaggtgaccctggacgaggatggcgacttcctgagggccaaggccctgaccaaggagtctacactgatcccatgcacagaggaggcagcctcccgctctggcagcaaggtggcaccataccctctgcacgataagctgagctatgtggccggcgactttgtgaagtacggcggcaagatcaagaatcaggacgatgccccattcgacacctatatcaagaatctgggagagtgggcaaacagcccatacgcaaccgagaaggtgaagtgtatctacacatatctgaagaagggccgcctgatcgaggatctggtggacgccggcgtgctgaagctggatgagaaccagcagctgatcgagaagtgggagaagcggtacgaggagctgctgggcgagaagcctgccatctttagctccggcgcaaccgaccaggccagcgccttcgtgcggttcaacgtgttccacccagagtccatcgacgacgtgtggaaggataaggagatgttcgactcctttatctctttctataacgataagctgggcgaggaggacatctgcttcgtgaccggcaatcggctgcccagcacagagagacacgccaacaagatcaggcacgccgccgataaggccaagctgatcagcgccaatgacaactccggctttaccttccggggccggttcaagaccagccgggaggcagtgggaatcagctacgaggtgtcccagaaggcccacaatgccctgaagtggctgatccaccgccagtccaagtctatcgacgatcgggtgttcctggtgtggtctaatgataacagcctggtgccaaatcccgatgaggacgccgtggacatcatgaagcacgccaacagggagctggagcgcgatccagacaccggacagatcttcgcaggagaggtgaagaaggcaatcggaggctaccgcagcgatctgaactatcagcccgaggtgcacatcctggtgctggactctgccaccacaggccgcatggccgtgctgtactatcggagcctgaataaggagctgtacctgaaccgcctggaggcctggcacgattcttgtgcctgggagcaccggtatcggagagacgagaaggagtttatcagcttctacggcgcccccgccaccaaggatatcgcctttgccgcatatggacctagggcctccgagaaagtgatcaaggacctgatggagcggatgctgccttgcatcgtggatggcaggcgcgtgccaaaggacatcgtgcggagcgccttccagagagcctccaatcccgtgtctatggagagatgggagtgggagaagaccctgtccatcacatgtgccctgatcaggaagatgcacatcgagcagaaggaggagtggggcgtgcctctggataagtctagcaccgaccgcagctacctgtttggccggctgctggccgtggcagatgtgctggagaggggcgccctgggcaaggacgagaccagagccacaaacgccatcaggtacatgaatagctattccaagaaccctggccgcacctggaagacaatccaggagtccctgcagccatatcaggccaagctgggcaccaaggccacatacctgtctaagctggtggatgagatcggcgaccagtttgagcctggcgacttcaacaataacccactgaccgagcagtacctgctgggcttctatagccagcggagagagctgtacaagaagaaggaggaggagacaaaccagtga

SEQ ID NO: 1260 - DNA, 4290 bp, Desulfovibrio vulgaris
atgggccccaagaagaagagaaaggtaggcagcggcatgaccgcaatcgcaaaccgctatgagtttgtgctgctgttcgacgtggagaacggcaatccaaacggcgaccccgatgccggcaatatgcctaggatcgacccagagaccggacacggactggtgacagacgtgtgcctgaagagaaagatcaggaaccacgtggccctgacaaaggagggcgccgagaggttcaacatctacatccaggagaaggccatcctgaatgagacccacgagcgcgcctatacagcctgtgacctgaagccagagcccaagaagctgccaaagaaggtggaggacgccaagcgggtgaccgattggatgtgcacaaacttttacgatatcagaaccttcggcgccgtgatgaccacagaagtgaattgtggacaggtgcggggaccagtgcagatggcctttgccagatccgtggagcccgtggtgcctcaggaggtgtctatcacccggatggccgtgaccacaaaggccgaggccgagaagcagcagggcgacaacagaacaatgggcaggaagcacatcgtgccatacggcctgtatgtggcacacggcttcatcagcgcccccctggccgagaagaccggcttttccgacgaggatctgacactgttctgggacgccctggtgaatatgtttgagcacgatcgctccgccgcaaggggactgatgagctcccggaagctgatcgtgtttaagcaccagaatagactgggcaacgcccctgcccacaagctgttcgacctggtgaaggtgtctagggcagagggctctagcggccctgcacgcagcttcgccgattatgcagtgaccgtgggacaggccccagagggagtggaggtgaaggagatgctgggctccggcgagggaaggggctctctgctgacatgcggcgacgtggaggagaaccctggacctccaaagaagaaaagaaaagtcggcagcggcatgacccacggagcagtgaagacatacggcatcagactgagggtgtggggcgactatgcctgttttacccggcctgagatgaaggtggagagagtgagctacgatgtgatgccaccatccgccgcaaggggcatcctggaggcaatccactggaagccagccatcagatggatcgtggacagaatccacgtgctgcgccccatcgtgttcgataatgtgcggagaaacgaggtgtcctctaagatccctaagccaaacccagcaacagcaatgagggataggaagcccctgtattttctggtggacgatggctccaacaggcagcagagggcagccaccctgctgcggaatgtggactacgtgatcgaggcccacttcgagctgacagacaaggccggcgccgaggataatgccggcaagcacctggatatcttcaggcgccgggcaagggcaggacagagctttcagcagccttgcctgggctgtcgcgagtttccagcctccttcgagctgctggagggcgacgtgccactgtcttgctacgcaggcgagaagcgggatctgggctatatgctgctggacatcgatttcgagagagacatgaccccactgttctttaaggccgtgatggaggatggcgtgatcacccctccatctaggacaagccccgaggtgcgcgcaggcagcggcgagggcaggggctccctgctgacatgtggcgacgtggaagaaaaccctggacctcccaagaaaaagaggaaagtgggcggctcccagctggtgaagtctgagctggaggagaagaagtccgagctgcggcacaagctgaagtacgtgcctcacgagtatatcgagctgatcgagatcgcccggaatccaacccaggacagaatcctggagatgaaagtgatggagttctttatgaaggtgtacggctataggggagagcacctgggaggcagccgcaagcccgatggcgccatctacaccgtgggctcccctatcgactatggcgtgatcgtggatacaaaggcctacagcggcggctataacctgccaatcggacaggcagacgagatgcagcggtacgtggaggagaatcagaccagaaacaagcacatcaatcccaacgagtggtggaaggtgtatcctagctccgtgacagagttcaagtttctgttcgtgtctggccactttaagggcaactacaaggcccagctgaccagactgaatcacatcacaaattgcaacggagccgtgctgagcgtggaggagctgctgatcggcggcgagatgatcaaggccggcaccctgacactggaggaggtgagaaggaagtttaacaatggcgagatcaacttctctgctagcgagacacctggcacctccgagtctgccaccccagagtccggcggctctggctctagcggcggctctggctcctccggaggaatgatcctgcaggccctgcacggatactatcagagaatgtccgccgaccctgatgcaggaatgccaccctacggcaccagcatggagaatatctccttcgccctggtgctggacgccaagggcacactgaggggcatcgaggatctgcgcgagcaggagggcaagaagctgagaccaaggaagatgctggtgcccatcgccgagaagaagggcaatggcatcaagccaaactttctgtgggagaataccagctatatcctgggcgtggacgccaagggcaagcaggagaggaccgataagtgccacgccgccttcatcgcccacatcaaggcctactgtgacaccgcagaccaggatctggcagccgtgctgcagttcctggagcacggcgagaaggatctgtctgcctttcccgtgagcgaggaagtgatcggctccaacatcgtgttcagaatcgagggcgagcccggctttgtgcacgagagacctgcagcaaggcaggcctgggccaattgtctgaacaggagggagcagggactgtgcggacagtgtctgatcaccggcgagaggcagaagcctatcgcccagctgcacccaagcatcaagggaggaagggacggcgtgcggggagcacaggccgtggccagcatcgtgtcctttaacaataccgccttcgagtcttacggcaaggagcagagcatcaacgcacccgtgtcccaggaggcagccttttcttacgtgacagccctgaattatctgctgaatccttccaacaggcagaaggtgaccatcgccgatgccacagtggtgttctgggcagagcgcagctccccagcagaggacatctttgccggcatgttcgatcctccatctaccacagccaagcccgagtctagcaacggaaccccccctgaggactctgaggagggcagccagccagatacagcaagggacgatccacacgcagcagcaaggatgcacgacctgctggtggccatcagatctggcaagagggccaccgatatcatgcccgacatggatgagagcgtgagatttcacgtgctgggcctgtctcctaatgcagcaaggctgagcgtgcggttctgggaggtggacacagtgggccacatgctggataaagtgggcagacactatagggagctggagatcatccctcagtttaacaatgagcaggagttcccatccctgtctaccctgctgagacagacagccgtgctgaataagaccgagaacatctctccagtgctggccggaggactgttcagggcaatgctgacaggaggaccttacccacagagcctgctgccagccgtgctgggacgcatccgggcagagcacgcacggcctgaggacaagtccagatacaggctggaggtggtgacctactatagagccgccctgatcaaggcctatctgatccgcaaccggaagctggaggtgcccgtgtccctggaccctgcaaggaccgataggccatatctgctgggccgcctgtttgccgtgctggagaaggcacaggaggacgcagtgcctggagccaacgccacaatcaaggatcggtacctggccagcgcctccgccaatccaggacaggtgttccacatgctgctgaagaatgcctccaaccacaccgccaagctgcggaaggaccctgagagaaagggctctgccatccactacgagatcatgatgcaggagatcatcgacaatatcagcgatttcccagtgaccatgtcctctgatgagcagggcctgtttatgatcggctactatcaccagaggaaggccctgttcacaaagaagaataaggagaactga

SEQ ID NO: 1261 - DNA, 4497 bp, Geobacillus thermocatenulatus strain KCTC 3921
atgggccccaagaagaagagaaaggtaggcagcggcatgatggagagatatatcgatcccaccaagaggcacgagtttgtgctgctgttcgacgtgaaggatggcaaccctaatggcgacccagatgcaggaaacatgccccgggtggaccctgagacaatgcacggcatcgtgaccgatgtggccatcaagagaaagatcagggactatgccgccatggtgctgggcaagcctatctttatccagtctcagacagccctgaacaccatcatcttccaggcctaccaggatgtgggcgtgaagctggccaccatcgagctgaatgaggaggagaaggagaacggcgagctgatgaattggctgagccagctggaggagcagggactggtgctggaggacaatagagtgatctacacaggcgaggatatcaaggagaaggacatcagggagaagctgaccgagggcctggaggaggcaggcctgaagaagcagctggagaagagcctgcgcaacatggcaaagcggctggcccaggccgccaacaatatgaagatcgatgagcagacccgccagaatgcccagaaggccctgtgccagaagtactatgacgtgcggatgttcggcgccgtgatgtccacaggcctgaacgcaggacaggtgaggggaccaatgcagctgaccttttcccgctctatcgatcccgtgttcccatgggacctgaccatcacaagaagcgccatcacaaaggagtccgatcggagaaggaagcagaccgagatgggccgcaagcccctgatcccttacggcctgtatcggctgcacggcttttacaatcccttcctgggcgagaagacaggagtgaccgcagaggacctggcagatttttgggacgccctggtgcacctgttcgcctttgaccacagcgccgcaaggggagagatgaacgtgcgggccctgtatatcttttcccacgagaatgccaagggctctgcccctgcccacaagctgttcgatctggtgaagatcgagcgccggcagcaggaggcaccaagatccttccacgactacgtgctgctgggaccagcagatgagggacagaaggacgtgtttctggagggcttctctggcgtgaccgtgacacggctggtgggctctggcgagggaagaggcagcctgctgacctgcggcgacgtggaggagaaccctggacctccaaagaagaaaagaaaagtcggctccggcatgcagagaagggccaaggtgcaggtgaaagtgtggggcgagtacgcctgttttacacgcccagagttcaaggtggagcggatcagctatccagtgatgaccccatccgccgcaaggggcgtgctggaggccatcttttggaagcccgagttcagatacgaggtgaggcagatcggcatcctgagcctgggaggacagcaggcaatcctgcggaacgagctgacatccaagcagaacaagaatcctatcgtgatcgagtctgccagggcacagcggaccagcctgatcctgaagaacgtggcctactggatcgtggccgatatcatcctgacaaatagggcagtggaccccgcagccaagtatagagaccagttcaatcgccgggtggagaggggacagtgccaccacacaccttacctgggcacccgcgagtttgccgcctatttcagctccatcgacgaggacgatgtggtgaagccagtggacatggatatcggcaccatgctgctggatttcgcctttatcgaggacggcagcagaaaggagatggagtttctgagatacgaggagaccggaacacgcaccgcagtgggattcgcaaagccactgttctttgaggccaaggtggagaacggctggctgcacgtgcccaaggagacctaccagcagctgtatgccctggagggccagaatgccctgagggtggatggctccggcgagggaaggggctctctgctgacatgtggcgacgtggaagaaaaccctggacctcccaagaaaaagaggaaagtgggcggctcccagctggtgaagtctgagctggaggagaagaagagcgagctgaggcacaagctgaagtacgtgcctcacgagtatatcgagctgatcgagatcgccagaaatccaacccaggatagaatcctggagatgaaagtgatggagttctttatgaaggtgtacggatataggggagagcacctgggaggctccagaaagccagacggagccatctacacagtgggctctcctatcgattatggcgtgatcgtggacaccaaggcctactccggcggctataacctgcccatcggccaggccgacgagatgcagaggtacgtggaggagaaccagacccgcaataagcacatcaaccccaatgagtggtggaaggtgtatccttctagcgtgacagagttcaagtttctgttcgtgagcggccacttcaagggcaactacaaggcccagctgacacggctgaatcacatcaccaactgtaatggagccgtgctgtccgtggaggagctgctgatcggcggcgagatgatcaaggccggcacactgaccctggaggaggtgagaaggaagtttaacaatggcgagatcaacttctctgctagcgagacacctggcacctccgagtctgccaccccagagtccggcggctctggctctagcggcggctctggctcctccggaggaatgcactggagagataagatgctgtatgagctgatcgagctggccgccaagctgcagagggagaagaagctgcctccaatcagctacaagcccaagtccatcaactggatcatcgatctgggaggcgaccagccttacctgaagggaccatttcgccggggagagtataggctggtggaggcacctttccgcctgaggcagggcaaggtgaccgaggagaatgtgaagccatacctgctggccgacgatggcagatatgtgctgggcatcccagagtcccccgagaaggcagacgaggcagagctgatgcacaagggctacgtgaggctgatcgaggaggcctatgagaagacaaagctgaaggagctgaagaaggtgctggattttctgtattctcctatgaagaacgccttccgggagcagatcggcgccaaggacatcgtgacattccaggacgatgaggagagcctgatctttgagaagtccgagatccagaccttctgggccgagtacctggcctccgatctgctgtctgacgatgagtgcgactgtagcgtgtgcggcaagagaagcgcctacgtgaggtatctgccaaatcccgtgcagctgtttggccagtcttgtcagctgaccagctttaacaatccctctttcgagagcatgggcaagacacagaccaacaatgtgcccgtgtgcttcggctgtgccacactggtggtggataccctgaactacctgatcagagaggaccagcaccacacacctctgtatatctccgataggaatatcctgcagtctcagatggccatctactgggtggacgatcagatcgagggcagaggctgcatccagctggacgagaagctgtttgcctctcctatcgagcagtggctgttcgacgaggatacaaaccagcgcaccccccctccagagctgaagcagctggaggagctgctggccctgccaaagacaggaagggagcaggccctgcacctggacaagaccttctttcacatggccgtgctgtccgccaataaggcaaggctggtggtgcgggagtggattcacacctccatctctcagctgctgatgcacctggagcggtacgcagcagccgtgcggatcgtgcagcctacaggcgagaagggctatctgctgccactggccgccctgatcagggcagtggatatgagcccaggcctggtgagacagtgtctgaggacaatctatcagggcgccctgccacctaccgagctgctgcccctggccctgcagcggttcagaagcctgaaggtgctgtctgaccctaaggagacctggagataccactctagcgcctctctgctgaagctggtgctgacatatggcaaggaggaggccaacaccatgcagagcctgaacaatcactgcctgcagcccgcctacatctgtggcaggctgctggccgtgctggaggagatccagagaagggccctgggctaccggatcggctctaccatcgtggatcggttctacggagcagccagcacagcacctgccagcaccttcggctccctgctgaggctgagcaccacagcacacctgccaaaggtgtccggcgagctgggccggctgctggaggaagtgatgaagcagctggacgaggcaggaggatttccaacaatcttcaatctgagggagcaggcagagtttgcactgggcttctaccaccagagggcagagttccgctctcggcaccagagcaaccagacaaatggcaccggcgagtcccagtga

SEQ ID NO: 1262 - DNA, 4806 bp, Vibrio cholerae strain L15 L15_contig8
atgggccccaagaagaagagaaaggtaggctccggcatggccaagaacaatgacatcgcctctgtgctggccttcgagaagaagctggtgcctagcgatggctacctgtttggctgccagtgggagaccaaggagcaggccaccccactgacactgcaggagaagagcgtgagaggcacaatctccaacaggctgaaggccgccgtgcagaacgaccctgccaagctgaatgccgaggtggagaaggccaatctgcagcgggtggatgcctgtgcactgggacaggaccacgataccctgaagctgcacttcacactgaaggtgctgggaggcctggcccagccatctgcctgcaacaatgccctgtttaagcagtcttacagcaccgccgtgagccagtacatcacaaagtatggctgtttcgagctggccaagagatatgccaccaacctggccaatgccaggtttctgtggcggaacagagtgggcgccgaggagatcgaggtgcaggtgaaggccctgaacaagggcgccgagcagacctggaccttcaacgccaagcagttctctaccaggcactttgaccacaacgatagccagctgaattccctggccgacaggatcgcacaggccctggccagcgagacagaccacctgatgctgcagatcgattgctacgccaaagtgggcaaggcccaggaggtgtatccctccgaggagctggtgctggataagggcaacagcaagaccaagaagtccaagatcctgtacgccgtgaacgagcacgccgccatgcactctcagaagatcggcaatgccctgcgcagcatcgacacatggtaccctgattatgcctctgaggagcagagcgccggagcaatcgcaatcgagccctacggcgccgtgaccaatctgggcaaggccttcagaacccctaaggacaagcaggacttctacaccttctttgacaagtgggcaaggggagagagcctgcctagggaggaggatgagcactacgtgatggccgtgctggtgcggggaggcgtgttcggagagtccgacaagggctctggcgagggaagaggcagcctgctgacctgtggcgatgtggaggagaaccctggacctcctaaaaagaaacgaaaggtaggctccggcatgaattactatcaggagatcacactgctgcccgacgcagatatcgccctgggcttcctgtggcagaacgtgtttcagcaggtgcacatcgccctggtggagcacaaggtggcctctaatcagagcctggtggccgtgggcttccctgactacagacaggccaagtttccactgggcgccaagctgaggctgttcgccaaggagcaggtgaccctggagaagctggacatccacagatggctgacaaggctggaggattacgtgcacatcaagggcgtgaagccagtgccctctgacgtgacctatgtgagctttgtgagaaagcaggtgaagtcccccgagcggatcgagagagatatgcagcagaaggccgagctgtgggccgccaagtctggcaagcctctggtggagtgcctggtggacctgcagcagtccaagcccaccgccctgtgctctctgcctttcatctacctgcacagccagcagacaaagcagaggtctccagagaagaacagcaagtttcccctgttcatcgagatgcagcagcagtccacatctcaggacggcggcttcgattgctatggcctgagctccaaggccaatggccagagcatgctggccaccgtgccacactttggctccggcgagggaaggggctctctgctgacatgtggcgacgtggaagaaaaccctggacctccaaagaagaaaagaaaagtcggctccggcatgaatgtgctgatcctgcctcacctgaagatccacaacgccaatgccctgtctagcccctttaccgtgggcttccctgccatgacagcatggctgggattcgtgcacgccctggagagaaagctgtcccaggccggcctgtctgatctgatgctgcacagcaccgcagtggtgtcccacaggtgcgacgtgcagacacacaagggcgagggcgatttcgtgcacagcatcatcggcaccgccaaccccctggacaaggatggcagccgctccgcctttatcgaggaggcccggtgtcacctggacgtgagcctggtcatcgagtggtccggcaatgaggagcaggtgcagcagcctgagtttaccgagcagctgcaggccgtgatcgccacaatgaaggtggcaggaggcgatgtgctggccgtgggcaagccttccgtgaagtctgtgatcaccgaggacgatacaggcagggtgctgaggcagctgatgccaggatacgtgctgatcgagcggagagacctgatgatcgatgccatgcagcagggcgacgatgcaatcgacgccctgctgggctatctgaccgtgcaccaccactgcgagcagctggaggatcagtctgtggtgtggcacagccagcggaagacctccggctggatcgtgcccatcgccacaggcttccagggcatctcccctctgggcgaggccaagaaccagagagaccctagcgtgccacacaggttcgcagagtccgtggtgaccctgggagagtttgtgatggtgcacaagatcaagcacctggacgatatcctgtggcagtaccacccagacctggagaacgatctgtatctgtgccagaaggtgaacgccatcaatgagcaccagggctctggcgaaggcaggggcagcctgctgacatgcggcgatgtggaagagaaccctggacctcccaagaaaaagaggaaagtgggcggctctcagctggtgaagagcgagctggaggagaagaagagcgagctgcggcacaagctgaagtacgtgcctcacgagtatatcgagctgatcgagatcgccagaaacccaacccaggacagaatcctggagatgaaagtgatggagttctttatgaaggtgtacggctatagaggcgagcacctgggcggctctaggaagccagatggcgccatctacaccgtgggcagccccatcgactatggcgtgatcgtggatacaaaggcctactccggcggctataatctgccaatcggacaggcagacgagatgcagcggtacgtggaggagaaccagacccggaataagcacatcaaccccaatgagtggtggaaggtgtacccttcctctgtgacagagttcaagtttctgttcgtgagcggccacttcaagggcaactataaggcccagctgaccagactgaatcacatcacaaactgtaatggagccgtgctgtccgtggaggagctgctgatcggcggcgagatgatcaaggccggcaccctgacactggaggaggtgaggcgcaagttcaacaatggcgagatcaacttttctgctagcgagacacctggcacctccgagtctgccaccccagagtccggcggctctggctctagcggcggctctggctcctccggaggaatgatcgacccagtgatcgccgccttctttgccgagaggaaggaggcctggctgaagaagaatatcagcgccgcaatgtccgatgcagaggtgctggagaagcagcaggagtgcgagcagaacttcctgctggacaattggctgcccgatgcagcaaagagggcaggacagatctctgtggccagccacccatgtacattttcccacccctctgcccgcaagaacaagaatggctacgtgtcctctatcatcgccaagaacaagccacgcatcgacggcttcctgcggtctggcaacgtgagcgtggagccagacgccctgggaaatgcagccgccctggacgtgtacaagtttctgtccctggagatgtctgatcagcgcagcctgctggtgcacatcgagcaggagagcgagctggccaggcagctgctggacatcccttcctgcgagtatcaggccctgagagatggcttcctgaagatggtggactccgatcaggcctctgtgagctcctctaagatcaagcaggtgtactttccaatcgccgacggcgagtatcacctgctgtccctgctgacccactctggccacctgttcgagctgaggaagcgcctggacgccctgaggtttggcgatgccgtgaaggaggcccgggagtgtaagaagaccaaccacttccacccagccggctaccaggagatcttcggcctgaccacaatcggctttggcggcacaaagccccagaacatcagcgtgctgaacaatcagaatgcaggcaaggcacacctgctggcctccatcccccctgagctgacccctcgggacatcagactgccaaagacagatttctttaaggagtccttcaacgcctggcaggccaaggaggtgctggagtctctgcacagactgtttcagaccgactgcaacaatatcaatctgagggacggccgcgattacagaatccagcagtatgtggacctggtcatcgagaagatgtggcaggtgaggctgttcctggaggcctacagcggcgagctgagctccgccctgcctctggagcagaagatctggctgtatccagagtttgcagagcagaggcagcaggaggacgagtggctggataagatcatccgccacatcgcccggggcctgatcaaccactacagccggtccaaagtgatcaccaatcctgtgacactggccgaccaggagctgctggccatcgaggaggtggtggcctccaacaaggagaatctgagatga

SEQ ID NO: 1263 - DNA, 4866 bp, Pseudomonas aeruginosa UCBPP-PA14
atgggccccaagaagaagagaaaggtaggctctggcatgagcaagcccatcctgtccaccgcctctgtgctggcctttgagcggaagctggacccttctgatgccctgatgagcgccggagcatgggcacagagagatgccagccaggagtggccagccgtgacagtgagagagaagtccgtgaggggcaccatctctaaccgcctgaagacaaaggaccgggaccccgcaaagctggatgccagcatccagtcccctaacctgcagaccgtggacgtggccaatctgccaagcgacgccgataccctgaaggtgcgcttcacactgcgggtgctgggaggagcaggaacaccatccgcctgcaatgatgccgcctatagagacaagctgctgcagaccgtggccacatacgtgaacgaccagggatttgcagagctggcccggagatacgcccacaacctggccaatgccaggttcctgtggaggaacagggtgggagcagaggcagtggaggtgcgcatcaatcacatcaggcagggagaggtggcaagggcatggcggtttgatgccctggccatcggcctgagagacttcaaggcagatgcagagctggacgccctggccgagctgatcgccagcggcctgtctggcagcggccacgtgctgctggaggtggtggcctttgccaggatcggcgacggccaggaggtgttcccttcccaggagctgatcctggacaagggcgataagaagggccagaagtccaagaccctgtactctgtgcgggatgcagcagcaatccacagccagaagatcggcaatgccctgagaaccatcgacacatggtatccagacgaggatggactgggaccaatcgcagtggagccttacggctctgtgaccagccagggcaaggcctataggcagcccaagcagaagctggacttctacacactgctggacaattgggtgctgagggatgaggcacctgcagtggagcagcagcactacgtgatcgccaacctgatcaggggaggcgtgttcggagaggcagaggagaagggcagcggcgagggaaggggctccctgctgacctgtggcgacgtggaggagaaccctggacctcctaaaaagaaacgaaaggtaggctccggcatggatcactatctggacatcagactgaggccagatcccgagtttccacccgcccagctgatgtctgtgctgttcggcaagctgcaccaggccctggtggcacagggaggcgaccggatcggcgtgtcttttccagacctggatgagtcccgctctcggctgggagagcggctgagaatccacgccagcgccgacgatctgagagccctgctggccaggccatggctggagggactgcgcgatcacctgcagttcggagagcctgcagtggtgcctcacccaaccccctacagacaggtgtctagggtgcaggccaagagcaacccagagcggctgaggcgccggctgatgagaaggcacgacctgagcgaggaggaggcaaggaagagaatccccgacacagtggcacgcgccctggatctgccctttgtgaccctgcggagccagtccacaggccagcactttcgcctgttcatcaggcacggaccactgcaggtgaccgcagaggagggaggcttcacatgctatggcctgtccaagggcggctttgtgccttggttcggctccggcgaaggcaggggctctctgctgacctgtggcgatgtggaggagaaccctggacctccaaagaagaaaagaaaagtcggctccggcatgtctgtgacagaccctgaggccctgctgctgctgccaagactgagcatccagaacgccaatgccatcagctccccactgacctggggattcccttccccaggcgcctttacaggattcgtgcacgccctgcagcgccgggtgggcatctccctggatatcgagctggacggagtgggaatcgtgtgccaccgctttgaggcccagatctctcagccagccggcaagcggaccaaggtgttcaacctgacacgcaaccccctgaatcgggatggctctaccgcagcaatcgtggaggagggaagagcacacctggaggtgagcctgctgctgggagtgcacggcgacggcctggacgatcacccagcccaggagatcgcaagacaggtgcaggagcaggcaggagcaatgaggctggccggaggctctatcctgccatggtgcaacgagaggtttcccgcccctaatgcagagctgctgatgctgggaggcagcgacgagcagagaaggaagaatcagcgccggctgaccagaaggctgctgccaggattcgcactggtgagcagagaggccctgctgcagcagcacctggagacactgaggaccacactgcctgaggcaaccaccctggacgccctgctggacctgtgcagaatcaactttgagccacctgccacctctagcgaggaggaggccagcccacccgacgcagcctggcaggtgagggataagcctggatggctggtgccaatcccagcaggatacaacgccctgtcccctctgtatctgccaggcgaggtgcgcaatgccagagatagggagacacccctgcggtttgtggagaacctgttcggcctgggcgagtggctgtctcctcacagggtggccgccctgagcgatctgctgtggtatcaccacgccgagcctgacaagggcctgtacagatggagcaccccaaggttcgtggagcacgcaatcgcaggcagcggcgaaggcagaggctccctgctgacatgcggcgacgtggaggagaaccctggacctcccaagaaaaagaggaaagtgggcggcagccagctggtgaagtccgagctggaggagaagaagtccgagctgcggcacaagctgaagtacgtgcctcacgagtatatcgagctgatcgagatcgccagaaacccaacccaggatagaatcctggagatgaaagtgatggagttctttatgaaggtgtacggctatagaggcgagcacctgggaggctccaggaagccagacggagcaatctacaccgtgggctctcctatcgactatggcgtgatcgtggatacaaaggcctacagcggcggctataatctgccaatcggacaggcagacgagatgcagcggtacgtggaggagaaccagacccggaataagcacatcaacccaaatgagtggtggaaggtgtacccctcctctgtgacagagttcaagtttctgttcgtgtctggccacttcaagggcaactataaggcccagctgacccgcctgaatcacatcacaaactgtaatggagccgtgctgtccgtggaggagctgctgatcggcggcgagatgatcaaggcaggcaccctgacactggaggaggtgcgccggaagtttaacaatggcgagatcaacttctctgctagcgagacacctggcacctccgagtctgccaccccagagtccggcggctctggctctagcggcggctctggctcctccggaggaatgacatctcctctgccaacccccacatggcaggagctgagacagtttatcgagagcttcatccaggagaggctgcagggcaagctggataagctgcagcctgacgaggacgataagcggcagaccctgctggccacacacagaagggaggcctggctggccgatgcagcacgccgggtgggacagctgcagctggtgacccacacactgaagccaatccaccctgacgcaaggggctctaatctgcacagcctgccacaggcaccaggacagcctggcctggccggctctcacgagctgggcgataggctggtgagcgacgtggtgggaaacgcagccgccctggacgtgtttaagttcctgtccctgcagtaccagggcaagaacctgctgaattggctgaccgaggatagcgccgaggccctgcaggccctgtccgacaatgcagagcaggcaagagagtggaggcaggcctttatcggaatcaccacagtgaagggagcaccagccagccactccctggccaagcagctgtactttcctctgccaggcagcggctatcacctgctggccccactgttccccacctccctggtgcaccacgtgcacgccctgctgagggaggcaaggttcggcgacgcagccaaggccgccagagaggcacgctcccggcaggagtcttggccacacggctttagcgagtaccctaatctggccatccagaagttcggcggcaccaagccccagaacatctcccagctgaacaatgagagaaggggcgagaactggctgctgccttctctgccccctaattggcagagacagaacgtgaatgccccaatgaggcactccagcgtgttcgagcacgatttcggccgcacccctgaggtgagcagactgaccaggacactgcagcggttcctggccaagacagtgcacaacaatctggccatcagacagaggagggcacagctggtggcacagatctgcgacgaggccctgcagtacgcagcaagactgagggagctggagccaggatggtccgccaccccaggctgtcagctgcacgacgcagagcagctgtggctggaccccctgagggcacagaccgacgagacatttctgcagagaaggctgaggggcgattggccagcagaagtgggaaacaggttcgcaaactggctgaatcgggccgtgagctccgactctcagatcctgggcagccccgaggcagcacagtggagccaggagctgtccaaggagctgaccatgttcaaggagatcctggaggacgagagggattga

SEQ ID NO: 1264 - DNA, 3405 bp, Shewanella putrefaciens CN-32
atgggccccaagaagaagagaaaggtaggcagcggcatgcagaaggtgaccggcatcaagtccgtggacttcaagatcaaggccctgggccacggcgtggtgaactggaatggccccaccacactgacaggcgacgatggcaagaccgtggacaatcacacactgcctaagctgagaggctacaccaacctgacaggcaaggtgaaggatgagaccggctacaagtataagaagcaggccaccgacatcaatttcaaggagacacctctgtacatcagccagaactgcatccggcaccacctgtttagagagcaggccttcgatctgcactatgcctctgacaagaacctgaagaatgtgctggccagcatcaccggactgatcaggggatacgtggtgccaagctcccagtgtaagcggacatcccccctgctgctggaggattttgtggaccagctgggcaacggcaatttcgagcagtacggacaggcaggagcaagggatagcacctccttctttagcaagaccacattcggcgacacagagtacatctcctatggctctatcagcatcgagcagctgcagtttatcagcctggataagaagttcgaccgcgccgccatggtcatcaaggagggagagggagaagtgatcgcagcagagctgcagaattacatccagagcctgaacccctccctgaatcctcaggccatctttcactctaactatgtgcggagaggcaccatcttcgaggagggcgagtgcggcatcctgctgaatgacgatgcagtgaaggccctggtggcagagaccctggagagactggccaacctgtccatcaggcaggccaagggctacatgtatgtggacgatatcacagtggattacaatgactctcacaagatgatgcggatcaagagagatgagagcgagatcatcaacgagcagcacgccccttttgcccagtacttctatgcaaagggctctggcgagggaaggggcagcctgctgacctgtggcgacgtggaggagaaccctggacctcctaaaaagaaacgaaaggtaggctctggcatgaacagctatatcgatatccgcctgaagccagacgcagagatgagggaggcagagctgtctagcaaggtgtttaccaagttccacaaggccctggtgacactgaactcccacaagatcggcatctcttttccacagatgaagctgtccctgggccagctgttcagaatccacggcgatgcctctctgctgcacgatctgcagggcctggactggctgggacctctggccggatactgccaggtgaccgccgtgagcgccgtgccagaccacgtgcagtataggatcgtgtccgtgaagcggagcaatctgagcaaggccaagctgaagaggctgatcgcccgcggcagcatcgacaaggatggcgagaagcggtacaaggtgaagatgctgggccagggctttgataacccatacctggacctgttctcctctagcaccggccaggtgtatagaaagttctttgagttttccgatatccaggcccacccactggatggcgagttcgactcctatggcctgtctaagaccgcaacagtgccatggttcggcagcggcgagggcagaggctccctgctgacatgcggcgacgtggaagagaaccctggacctccaaagaagaaaagaaaagtcggcggctctcagctggtgaagagcgagctggaggagaagaagagcgagctgcgccacaagctgaagtacgtgccccacgagtatatcgagctgatcgagatcgcccggaaccctacccaggatagaatcctggagatgaaagtgatggagttctttatgaaggtgtacggctatagaggcgagcacctgggaggctctaggaagcctgacggagccatctacaccgtgggcagcccaatcgattatggcgtgatcgtggacacaaaggcctactccggcggctataacctgccaatcggacaggcagacgagatgcagcggtacgtggaggagaaccagacccggaataagcacatcaacccaaatgagtggtggaaggtgtacccctcctctgtgacagagttcaagtttctgttcgtgtccggccactttaagggcaattataaggcccagctgacccggctgaaccacatcacaaactgcaatggcgccgtgctgtctgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaagatcatcatcgagtacgactcctgctggagaaacgccttcctgggcggctctaacaatgagcctgtgccaaagaagggcagggagtttctgggcagcatgacatccctgaagaaggagggcaacttcaaggtgtgcgagaataccctggatacagtgatgggcgtgctgaacaggctgatcggcgaccagaggaagctgtaccaggcacggtccaagatgtatgagtctgcctactattttgaggccctggaggataaggtgagcttcatcgacaagccccagctgaccaatgagatctcctttatcagaaacatgaatggctctaccgatcagaacgccttcacaggcatgatcaaggtgagcgaccccgtgttcacctctgagtacagccagcagttctggggcgtgctggccctggacttcacccagctgtgcgacttcatcatcaagcagagccaggtggtgggctccatcgagctgaaccccctgtctatcatcaataggctggagagcctgaaccaggagaaggccctggagaatagcgacgatctggcccaggtgctgaaggtgctgaacgagtactttccagacatcgagtatctgaacaataagggcctgatcacccccatcagcatctactgttccgccctgtatctgcagctggcccgcctggagacctccttcaatatgaccacagccaagacaaaggccggcggcatctccggcatctctaagagaggctttaccaagaaggatttcatggacaggtacaccacaggccccaagaagacaatctggggcaacccttttatcaagaaggagaagatcaagggccagggcgaggtgacctctatgatgacaaaggccagcggccagctggagatctccatcgacgtggatcgggacaaggcccaggagatcaagatcctgatcgagaatgccggcgtgtcctctttctacctgggcaagaagggcctggcctatgtgagcaacatcaagctgtga

SEQ ID NO: 1265 - DNA, 3501 bp, Acinetobacter sp. 869535
atgggccccaagaagaagagaaaggtaggcagcggcatggccaaggtgacaggcgtgaagtccgtggacttcaagatcaccgcctacggctatggcgtggtgaactggaatggcccaacaagcctgaccggcaatgacggcaagacagtggataaccacaccctgcccaagctgagaggcttctccaatctgtctggcagggtgaaggaggagacaggctacaagtataggaaggaggcctctgacatcgacttcaacgagacccctctgtacatcagccagaactgcatcaggcaccacctgtttcgcgaccagtccttcgatctgcactatgccaaggacaagaacctgatcgatgtgctggcctctatcaccggactgatcaggggatacgtggtgccaagctcccagtgtaagcggacaagccccctgctgatcaccgacttcatcgatcagctgggcaacggcaattttgagcagctgagcaatgcctctagctccgaggagatcacacaggacgatggctccaagacctacaagcgcggcgagaacagcatcttttccaagaccacattcggcgacaccgagtacatcgcctatggctccatctctatcgagcagctgcagtttatctccctggacaagaagttcgatagagcctctatgatcatcaaggagggcgagggcgagaagatcgccgagagggtgcaggagttcatcaagagcctggaccccagcaaggagcctaaggccatcttccacaagaattacgtgcggaagggcacaatctttaacgagggcgaagtgggcatcctgctggacaatacagccatcgatatcctggtgaaggagaccctgagcatgctggaggagctggtcatcaagcaggccaagggctacatgtgcgccgacaccgtggaggtggactataacgattcccacaagatgatgaggatcaagcgcaatccagaccaggccaaccccgagctgcagcaggattacgccgtgtatttcgaggcacagggcagcggcgagggaagaggctccctgctgacatgtggcgacgtggaggagaaccctggacctcctaaaaagaaacgaaaggtaggcagcggcatgaattactatatcgaggtgaccctgatggagaacgatcagttttctccttacgagctgtggagccagctgtatccacagctgcacctggccctggtggaggcaaagaacgccgacaataaggtgaacatcggcttctcctttccccagtaccgctttcaccaggataagggcgtgggcttcatcggcaccaagctgcggctgtttgccgagtccgaggccgacctgaagaagctggatatccggcggtggctggagagactggaggactatgtgcacgtgacatctatcagggaggtgcccaatgatatcaagaactacgccatctataagaggaagcaggtgaagaccaacgcacagcgcctggccaggcacagagtgaagcggggcgacatcggcttcgatgaggccctggcccgctacagcaatgtggtgaccacaaccaacatgccttatatcgagatgaagagcctgtccacatctgaccagcagtctgagaagcggtttaagctgttcatcgagaagcagtccgccgagaagtctgagacacaggtgttcagcacctacggcctgtctagcgtgtcctctgtgcctgagtttggctccggcgagggaaggggctctctgctgacctgcggcgatgtggaggagaaccctggacctccaaagaagaaaagaaaagtcggcggctctcagctggtgaagagcgagctggaggagaagaagagcgagctgagacacaagctgaagtacgtgcctcacgagtatatcgagctgatcgagatcgcccggaacccaacccaggacagaatcctggagatgaaagtgatggagttctttatgaaggtgtacggctatagaggagagcacctgggaggctccaggaagccagatggagccatctacacagtgggctctcctatcgactatggcgtgatcgtggataccaaggcctactccggcggctataacctgccaatcggacaggcagacgagatgcagcggtacgtggaggagaatcagacacggaacaagcacatcaaccctaatgagtggtggaaggtgtacccaagctccgtgaccgagttcaagtttctgttcgtgagcggccacttcaagggcaattataaggcccagctgacaagactgaaccacatcaccaactgtaatggagccgtgctgtccgtggaggagctgctgatcggcggcgagatgatcaaggccggcacactgaccctggaggaggtgaggcgcaagtttaacaatggcgagatcaatttctctgctagcgagacacctggcacctccgagtctgccaccccagagtccggcggctctggctctagcggcggctctggctcctccggaggaatgcagatcatcatcgagtacgagagctcctggcgcaactccttcctggacggctctaacaatgagcctctgccaaagggcggccggaacttcatcgcctccatgacaaccctgaagcaggagggcaactacaagaagcggagcatctctaaggatacagtgatgggcatcctgaacaggctgatcggcgaccagcgcaagctgtatcaggcccggcaggatgagaattactatttcaccgaggtggagaaggtgctgcaggagaacgacatcgtggatcacgccctgaacagcaatgagatggtgtacatcagaaacgtgagcggcagcacagaccagaactccttcaccggagagatcaaggccaatgatcccagcttttctagctccttctccgccgagctgtggggcgtgctgtggctgaacctgtccgaggtgtctaagtttatcctggacgagtcttacagcgtgacatattctgaggtgctggaccccatcaccgtgtgcaatcggatcgaggtgctgagcgccgagaagcctatggacctgaccgaggatatccaggccgtgctggactacctgctgaaccactttccagatacaaagtatctgaccgccaagaagcagctgcccctgatcagcatctacgcctccgccctgtatctgcagatcacacggctgtctcagagatacgacctgagcacagtgctgaccaagtccggcggactgagcggcatctccaagagaggctttaccaagaaggacttcatggataggtacacaaccggcagcaagaagctgatctggggcaatccttatctgctgaaggagaagaagaagggcgagggcgagatcgtgtctgtgctgacaaaggccagcggcaagctgatcatcaacctgaatatctccaaggagcaggccagagacctggaggagaagatcgagaacgccggcgtgtctagcttctacctgggcaagaagggcctggcctatgtgaccgatatcaggccatga

SEQ ID NO: 1266 - DNA, 4806 bp, Vibrio cholerae HE48 vcoHE48.contig.11; identical to SEQ ID NO: 1262

SEQ ID NO: 1267 - DNA, 29 bp, Artificial Sequence
  Synthetic: CRISPR repeats for Oceanicola sp. HL-35
ctgttccccgcacacgcggggatgaaccg

SEQ ID NO: 1268 - DNA, 29 bp, Artificial Sequence
  Synthetic: CRISPR repeats for Pseudomonas sp. S-6-2
gtgttccccgcacctgcggggatgaaccg

SEQ ID NO: 1269 - DNA, 29 bp, Artificial Sequence
  Synthetic: CRISPR repeats for Salmonella enterica subsp. enterica serovar Muenster strain
gtgttccccgcgccagcggggataaaccg

SEQ ID NO: 1270 - DNA, 29 bp, Artificial Sequence
  Synthetic: CRISPR repeats for Atlantibacter hermannii NBRC 105704
gtgttccccgcgccagcggggataaaccg

SEQ ID NO: 1271 - DNA, 29 bp, Artificial Sequence
  Synthetic: CRISPR repeats for Geothermobacter sp. EPR-M
ctgttccccgcacccgcggggatgaaccg

SEQ ID NO: 1272 - DNA, 29 bp, Artificial Sequence
  Synthetic: CRISPR repeats for Methylocaldum sp. 14B
ctgttccccacgtacgtggggatgaaccg

SEQ ID NO: 1273 - DNA, 29 bp, Artificial Sequence
  Synthetic: CRISPR repeats for Methanocella arvoryzae MRE50
aaagtccccacaggcgtgggggtgaaccg

SEQ ID NO: 1274 - DNA, 29 bp, Artificial Sequence
  Synthetic: CRISPR repeats for Pseudomonas aeruginosa DHS01
gtgttccccacatgcgtggggatgaaccg

SEQ ID NO: 1275 - DNA, 28 bp, Artificial Sequence
  Synthetic: CRISPR repeats for Lachnospiraceae bacterium KH1T2
gtattccccacgcacgtgggggtaaatc

SEQ ID NO: 1276 - DNA, 28 bp, Artificial Sequence
  Synthetic: CRISPR repeats for Klebsiella pneumoniae strain VRCO0172
gtattccccacacgcgtgggggtgtttc

SEQ ID NO: 1277 - DNA, 28 bp, Artificial Sequence
  Synthetic: CRISPR repeats for Streptococcus thermophilus strain ND07
gtttttcccgcacacgcgggggtgatcc

SEQ ID NO: 1278 - DNA, 28 bp, Artificial Sequence
  Synthetic: CRISPR repeats for Streptomyces sp. S4
gtcggccccgcacccgcggggatgctcc

SEQ ID NO: 1279 - DNA, 30 bp, Artificial Sequence
  Synthetic: CRISPR repeats for Campylobacter fetus subsp. testudinum Sp3
gtttgctaatgacaatatttgtgttaaaac

SEQ ID NO: 1280 - DNA, 30 bp, Artificial Sequence
  Synthetic: CRISPR repeats for Odoribacter splanchnicus DSM 20712
cttttaattgaactaaggtagaattgaaac

SEQ ID NO: 1281 - DNA, 32 bp, Artificial Sequence
  Synthetic: CRISPR repeats for Bacillus halodurans C-125
gtcgcactcttcatgggtgcgtggattgaaat

SEQ ID NO: 1282 - DNA, 32 bp, Artificial Sequence
  Synthetic: CRISPR repeats for Desulfovibrio vulgaris RCH1 plasmid pDEVAL01
gtcgccccccacgcgggggcgtggattgaaac

SEQ ID NO: 1283 - DNA, 37 bp, Artificial Sequence
  Synthetic: CRISPR repeats for Geobacillus thermocatenulatus strain KCTC 3921
gttgcacccggctattaagccgggtgaggattgaaac

SEQ ID NO: 1284 - DNA, 28 bp, Artificial Sequence
  Synthetic: CRISPR repeats for Vibrio cholerae strain L15 L15_contig8
gttcactgccgtacaggcagcttagaaa

SEQ ID NO: 1285 - DNA, 28 bp, Artificial Sequence
  Synthetic: CRISPR repeats for Pseudomonas aeruginosa UCBPP-PA14
gttcactgccgtgtaggcagctaagaaa

SEQ ID NO: 1286 - DNA, 28 bp, Artificial Sequence
  Synthetic: CRISPR repeats for Shewanella putrefaciens CN-32
gttcaccgccgcacaggcggcttagaaa

SEQ ID NO: 1287 - DNA, 28 bp, Artificial Sequence
  Synthetic: CRISPR repeats for Acinetobacter sp. 869535
gttcactgccatataggcagcttagaaa

SEQ ID NO: 1288 - DNA, 28 bp, Artificial Sequence
  Synthetic: CRISPR repeats for Vibrio cholerae HE48 vcoHE48.contig.11
gttcactgccgcacaggcagcttagaaa

SEQ ID NO: 1289 - DNA, 93 bp, Artificial Sequence
  Synthetic: homolog screen target set1_F_1
cgggcaggcagagctggaggcctttcaggcccctgttccccgcacacgcggggatgaaccgggcctgaggtgctgcctgggcatgtgtaaagg

SEQ ID NO: 1290 - DNA, 93 bp, Artificial Sequence
  Synthetic: homolog screen target set1_F_2
tctgtggctgtcgacatgctaagtgagggcctctgttccccgcacacgcggggatgaaccgtagtctcaagtttgttcaaagctggactcctc

SEQ ID NO: 1291 - DNA, 93 bp, Artificial Sequence
  Synthetic: homolog screen target set1_F_3
atgagtctaggttacattcagtgcaaaaaaccctgttccccgcacacgcggggatgaaccggtaagtttttaaaatatatatctaccatgtat

SEQ ID NO: 1292 - DNA, 93 bp, Artificial Sequence
  Synthetic: homolog screen target set1_F_4
atgattggaattatcttctagctcttgtcgaactgttccccgcacacgcggggatgaaccggtatcaagactgtgacttttaattgtagttta

SEQ ID NO: 1293 - DNA, 93 bp, Artificial Sequence
  Synthetic: homolog screen target set1_F_5
acaagttttgggtctcagcgcaggcctcagttctgttccccgcacacgcggggatgaaccgaggtctgtccagatgctaagaccaggtacttc

SEQ ID NO: 1294 - DNA, 93 bp, Artificial Sequence
  Synthetic: homolog screen target set1_F_6
gatttcctaaaggaatttaacaacaagaccatctgttccccgcacacgcggggatgaaccggttcctctgtctgatggacttattcaatgttt

SEQ ID NO: 1295 - DNA, 93 bp, Artificial Sequence
  Synthetic: homolog screen target set1_F_7
tcttagaccccagccacagggatatttccctgctgttccccgcacacgcggggatgaaccgttccttcgtcatccttgtaatccatcagggtc

SEQ ID NO: 1296 - DNA, 93 bp, Artificial Sequence
  Synthetic: homolog screen target set1_F_8
atgctgctcttcatctctcttatttaccactgctgttccccgcacacgcggggatgaaccgcaggcaatatctggaacttctccagtggcttc

SEQ ID NO: 1297 - DNA, 93 bp, Artificial Sequence
  Synthetic: homolog screen target set1_R_1
cctttacacatgcccaggcagcacctcaggcccggttcatccccgcgtgtgcggggaacaggggcctgaaaggcctccagctctgcctgcccg

SEQ ID NO: 1298 - DNA, 93 bp, Artificial Sequence
  Synthetic: homolog screen target set1_R_2
gaggagtccagctttgaacaaacttgagactacggttcatccccgcgtgtgcggggaacagaggccctcacttagcatgtcgacagccacaga

SEQ ID NO: 1299 - DNA, 93 bp, Artificial Sequence
  Synthetic: homolog screen target set1_R_3
atacatggtagatatatattttaaaaacttaccggttcatccccgcgtgtgcggggaacagggttttttgcactgaatgtaacctagactcat

SEQ ID NO: 1300 - DNA, 93 bp, Artificial Sequence
  Synthetic: homolog screen target set1_R_4
taaactacaattaaaagtcacagtcttgataccggttcatccccgcgtgtgcggggaacagttcgacaagagctagaagataattccaatcat

SEQ ID NO: 1301 - DNA, 93 bp, Artificial Sequence
  Synthetic: homolog screen target set1_R_5
gaagtacctggtcttagcatctggacagacctcggttcatccccgcgtgtgcggggaacagaactgaggcctgcgctgagacccaaaacttgt

SEQ ID NO: 1302 - DNA, 93 bp, Artificial Sequence
  Synthetic: homolog screen target set1_R_6
aaacattgaataagtccatcagacagaggaaccggttcatccccgcgtgtgcggggaacagatggtcttgttgttaaattcctttaggaaatc

SEQ ID NO: 1303 - DNA, 93 bp, Artificial Sequence
  Synthetic: homolog screen target set1_R_7
gaccctgatggattacaaggatgacgaaggaacggttcatccccgcgtgtgcggggaacagcagggaaatatccctgtggctggggtctaaga

SEQ ID NO: 1304 - DNA, 93 bp, Artificial Sequence
  Synthetic: homolog screen target set1_R_8
gaagccactggagaagttccagatattgcctgcggttcatccccgcgtgtgcggggaacagcagtggtaaataagagagatgaagagcagcat

SEQ ID NO: 1305 - DNA, 94 bp, Artificial Sequence
  Synthetic: homolog screen target set2_F_1
aatcagaccactcacagcataggagcagctctggtattccccacacgcgtgggggtgtttcactctgtgcatactctggggctgggagttacca

SEQ ID NO: 1306 - DNA, 94 bp, Artificial Sequence
  Synthetic: homolog screen target set2_F_2
atttctagccttacttccaccttatttcttcccgtattccccacacgcgtgggggtgtttcaaatagctcttcagttgtttctggttaattgag

SEQ ID NO: 1307 - DNA, 94 bp, Artificial Sequence
  Synthetic: homolog screen target set2_F_3
ttctattatgggatctgtaacactttattggatgtattccccacacgcgtgggggtgtttctcattatttctgcctagagatggatcaggaaat

SEQ ID NO: 1308 - DNA, 94 bp, Artificial Sequence
  Synthetic: homolog screen target set2_F_4
aaaataacaagtttcatggaagaatacccaaccgtattccccacacgcgtgggggtgtttcctttaatgattgggaatctggagttaagggaaa

SEQ ID NO: 1309 - DNA, 94 bp, Artificial Sequence
  Synthetic: homolog screen target set2_F_5
tcaccacatagtatgtccctttaaagcattgacgtattccccacacgcgtgggggtgtttcacaaactttctgaacaatacaattttaatgcat

SEQ ID NO: 1310 - DNA, 94 bp, Artificial Sequence
  Synthetic: homolog screen target set2_F_6
tgacggtggaaacgttctctactacgaagtgatgtattccccacacgcgtgggggtgtttcatcagtaacatggaagtctcaaatatttcagca

SEQ ID NO: 1311 - DNA, 94 bp, Artificial Sequence
  Synthetic: homolog screen target set2_F_7
cccttgcccttcttgtggcccagtggttttcaagtattccccacacgcgtgggggtgtttcacgggagaggggaggggaggagttcagaggaag

SEQ ID NO: 1312 - DNA, 94 bp, Artificial Sequence
  Synthetic: homolog screen target set2_F_8
tcacttgaggtcaggagttcaagaccaccctgggtattccccacacgcgtgggggtgtttcgatactgggccagatcattgtttctcaaattgc

SEQ ID NO: 1313 - DNA, 92 bp, Artificial Sequence
  Synthetic: homolog screen target set2_R_1
aggcctctaggaagacaggtggaggttagggatttctaagctgcctgtgcggcagtgaacaacctaattataaggaggttgttttggccatg

SEQ ID NO: 1314 - DNA, 92 bp, Artificial Sequence
  Synthetic: homolog screen target set2_R_2
cgctctggagccgcagtgcgcactgcgctgcgtttctaagctgcctgtgcggcagtgaacttattcaggactgactccccctgccagtccca

SEQ ID NO: 1315 - DNA, 92 bp, Artificial Sequence
  Synthetic: homolog screen target set2_R_3
tatgctcatagcaagatgccacatgaaacagttttctaagctgcctgtgcggcagtgaacggctgcgggcctagaaacaatagctggtgaaa

SEQ ID NO: 1316 - DNA, 92 bp, Artificial Sequence
  Synthetic: homolog screen target set2_R_4
attcaggagatccacattctctttttagtttatttctaagctgcctgtgcggcagtgaactaatactttttagctattaagtaattaagata

SEQ ID NO: 1317 - DNA, 92 bp, Artificial Sequence
  Synthetic: homolog screen target set2_R_5
cctcagaacaacttcctgaaggtgatagcggttttctaagctgcctgtgcggcagtgaacgatttgtggatgccgggttccaactcttcttg

SEQ ID NO: 1318 - DNA, 92 bp, Artificial Sequence
  Synthetic: homolog screen target set2_R_6
tgtccatcactcccataggctgagtttatttatttctaagctgcctgtgcggcagtgaaccaataaatacttatttagaccttgtgctacag

SEQ ID NO: 1319 - DNA, 92 bp, Artificial Sequence
  Synthetic: homolog screen target set2_R_7
ctgggaccctgatggattacaaggatgacgaatttctaagctgcctgtgcggcagtgaacaatatccctgtggctggggtctaagactttga

SEQ ID NO: 1320 - DNA, 92 bp, Artificial Sequence
  Synthetic: homolog screen target set2_R_8
aatattttggtcacatgaagaaatatgcaatatttctaagctgcctgtgcggcagtgaactggcctgtgaatggtctcaactaaccctttca

SEQ ID NO: 1321 - DNA, 102 bp, Artificial Sequence
  Synthetic: homolog screen target set3_F_1
tctggggaatctgtaaaaggtatatagaaactctctgtttgctaatgacaatatttgtgttaaaacaaacaaaaaaactaatctattggtacaatatagtta

SEQ ID NO: 1322 - DNA, 102 bp, Artificial Sequence
  Synthetic: homolog screen target set3_F_2
gtgttttaaagttacaccgatacattccagtgccttgtttgctaatgacaatatttgtgttaaaacataagaaaatcctgttttctctttaggacaggaact

SEQ ID NO: 1323 - DNA, 102 bp, Artificial Sequence
  Synthetic: homolog screen target set3_F_3
aataatagaataatggatcttcagtttacaagttttgtttgctaatgacaatatttgtgttaaaacctgatacctagggaatcagtcttatcccccatagga

SEQ ID NO: 1324 - DNA, 102 bp, Artificial Sequence
  Synthetic: homolog screen target set3_R_1
taactatattgtaccaatagattagtttttttgtttgttttaacacaaatattgtcattagcaaacagagagtttctatataccttttacagattccccaga

SEQ ID NO: 1325 - DNA, 102 bp, Artificial Sequence
  Synthetic: homolog screen target set3_R_2
agttcctgtcctaaagagaaaacaggattttcttatgttttaacacaaatattgtcattagcaaacaaggcactggaatgtatcggtgtaactttaaaacac

SEQ ID NO: 1326 - DNA, 102 bp, Artificial Sequence
  Synthetic: homolog screen target set3_R_3
tcctatgggggataagactgattccctaggtatcaggttttaacacaaatattgtcattagcaaacaaaacttgtaaactgaagatccattattctattatt

SEQ ID NO: 1327 - DNA, 102 bp, Artificial Sequence
  Synthetic: homolog screen target set4_F_1
gtgttttaaagttacaccgatacattccagtgccttcttttaattgaactaaggtagaattgaaacataagaaaatcctgttttctctttaggacaggaact

SEQ ID NO: 1328 - DNA, 102 bp, Artificial Sequence
  Synthetic: homolog screen target set4_F_2
aataatagaataatggatcttcagtttacaagttttcttttaattgaactaaggtagaattgaaacctgatacctagggaatcagtcttatcccccatagga

SEQ ID NO: 1329 - DNA, 102 bp, Artificial Sequence
  Synthetic: homolog screen target set4_R_1
agttcctgtcctaaagagaaaacaggattttcttatgtttcaattctaccttagttcaattaaaagaaggcactggaatgtatcggtgtaactttaaaacac

SEQ ID NO: 1330 - DNA, 102 bp, Artificial Sequence
  Synthetic: homolog screen target set4_R_2
tcctatgggggataagactgattccctaggtatcaggtttcaattctaccttagttcaattaaaagaaaacttgtaaactgaagatccattattctattatt

SEQ ID NO: 1331 - DNA, 100 bp, Artificial Sequence
  Synthetic: homolog screen target set5_F_1
atgactttgtaggtgtctttattgctaggctgtagtcgcactcttcatgggtgcgtggattgaaattgttatcatcatttatggagtgttgccactaacg

SEQ ID NO: 1332 - DNA, 100 bp, Artificial Sequence
  Synthetic: homolog screen target set5_F_2
caaattattccattaccacagcattaatcacacagtcgcactcttcatgggtgcgtggattgaaattgaggaggatacatgtcagatataagttgagatc

SEQ ID NO: 1333 - DNA, 100 bp, Artificial Sequence
  Synthetic: homolog screen target set5_F_3
tccatcttcagtgcctcaacttgctttaacaactgtcgcactcttcatgggtgcgtggattgaaatcaatcatcttacaaaactggaaactgaggcatct

SEQ ID NO: 1334 - DNA, 100 bp, Artificial Sequence
  Synthetic: homolog screen target set5_F_4
tcaccaaatatatgccttcgtgtgtccaaagtatgtcgcactcttcatgggtgcgtggattgaaattatattcaagtaataacacagcattgcctataca

SEQ ID NO: 1335 - DNA, 100 bp, Artificial Sequence
  Synthetic: homolog screen target set5_F_5
tttatgagatatttattggatgaagaaatagagcgtcgcactcttcatgggtgcgtggattgaaatacggagccagaggcctaagttcaattcttggcac

SEQ ID NO: 1336 - DNA, 100 bp, Artificial Sequence
  Synthetic: homolog screen target set5_F_6
cacccccaacccccacctttcctaaggacaggtcgtcgcactcttcatgggtgcgtggattgaaataacccacctcacttactctacatgcagggtccac

SEQ ID NO: 1337 - DNA, 100 bp, Artificial Sequence
  Synthetic: homolog screen target set5_F_7
ttcagagtctggattgacagttatttttgaaattgtcgcactcttcatgggtgcgtggattgaaatcaagtagctaatgaaaggaataatcttgctttag

SEQ ID NO: 1338 - DNA, 100 bp, Artificial Sequence
  Synthetic: homolog screen target set5_R_1
cgttagtggcaacactccataaatgatgataacaatttcaatccacgcacccatgaagagtgcgactacagcctagcaataaagacacctacaaagtcat

SEQ ID NO: 1339 - DNA, 100 bp, Artificial Sequence
  Synthetic: homolog screen target set5_R_2
gatctcaacttatatctgacatgtatcctcctcaatttcaatccacgcacccatgaagagtgcgactgtgtgattaatgctgtggtaatggaataatttg

SEQ ID NO: 1340 - DNA, 100 bp, Artificial Sequence
  Synthetic: homolog screen target set5_R_3
agatgcctcagtttccagttttgtaagatgattgatttcaatccacgcacccatgaagagtgcgacagttgttaaagcaagttgaggcactgaagatgga

SEQ ID NO: 1341 - DNA, 100 bp, Artificial Sequence
  Synthetic: homolog screen target set5_R_4
tgtataggcaatgctgtgttattacttgaatataatttcaatccacgcacccatgaagagtgcgacatactttggacacacgaaggcatatatttggtga

SEQ ID NO: 1342 - DNA, 100 bp, Artificial Sequence
  Synthetic: homolog screen target set5_R_5
gtgccaagaattgaacttaggcctctggctccgtatttcaatccacgcacccatgaagagtgcgacgctctatttcttcatccaataaatatctcataaa

SEQ ID NO: 1343 - DNA, 100 bp, Artificial Sequence
  Synthetic: homolog screen target set5_R_6
gtggaccctgcatgtagagtaagtgaggtgggttatttcaatccacgcacccatgaagagtgcgacgacctgtccttaggaaaggtgggggttgggggtg

SEQ ID NO: 1344 - DNA, 100 bp, Artificial Sequence
  Synthetic: homolog screen target set5_R_7
ctaaagcaagattattcctttcattagctacttgatttcaatccacgcacccatgaagagtgcgacaatttcaaaaataactgtcaatccagactctgaa

SEQ ID NO: 1345 - DNA, 100 bp, Artificial Sequence
  Synthetic: homolog screen target set6_F_1
atgactttgtaggtgtctttattgctaggctgtagtcgccccccacgcgggggcgtggattgaaactgttatcatcatttatggagtgttgccactaacg

SEQ ID NO: 1346 - DNA, 100 bp, Artificial Sequence
  Synthetic: homolog screen target set6_F_2
caaattattccattaccacagcattaatcacacagtcgccccccacgcgggggcgtggattgaaactgaggaggatacatgtcagatataagttgagatc

SEQ ID NO: 1347 - DNA, 100 bp, Artificial Sequence
  Synthetic: homolog screen target set6_F_3
tttatgagatatttattggatgaagaaatagagcgtcgccccccacgcgggggcgtggattgaaacacggagccagaggcctaagttcaattcttggcac

SEQ ID NO: 1348 - DNA, 100 bp, Artificial Sequence
  Synthetic: homolog screen target set6_F_4
cacccccaacccccacctttcctaaggacaggtcgtcgccccccacgcgggggcgtggattgaaacaacccacctcacttactctacatgcagggtccac

SEQ ID NO: 1349 - DNA, 100 bp, Artificial Sequence
  Synthetic: homolog screen target set6_R_1
cgttagtggcaacactccataaatgatgataacagtttcaatccacgcccccgcgtggggggcgactacagcctagcaataaagacacctacaaagtcat

SEQ ID NO: 1350 - DNA, 100 bp, Artificial Sequence
  Synthetic: homolog screen target set6_R_2
gatctcaacttatatctgacatgtatcctcctcagtttcaatccacgcccccgcgtggggggcgactgtgtgattaatgctgtggtaatggaataatttg

SEQ ID NO: 1351 - DNA, 100 bp, Artificial Sequence
  Synthetic: homolog screen target set6_R_3
gtgccaagaattgaacttaggcctctggctccgtgtttcaatccacgcccccgcgtggggggcgacgctctatttcttcatccaataaatatctcataaa

SEQ ID NO: 1352 - DNA, 100 bp, Artificial Sequence
  Synthetic: homolog screen target set6_R_4
gtggaccctgcatgtagagtaagtgaggtgggttgtttcaatccacgcccccgcgtggggggcgacgacctgtccttaggaaaggtgggggttgggggtg

SEQ ID NO: 1353 - DNA, 107 bp, Artificial Sequence
  Synthetic: homolog screen target set7_F_1
atgactttgtaggtgtctttattgctaggctgtacgttgcacccggctattaagccgggtgaggattgaaactgttatcatcatttatggagtgttgccactaacga

SEQ ID NO: 1354 - DNA, 107 bp, Artificial Sequence
  Synthetic: homolog screen target set7_F_2
tccatcttcagtgcctcaacttgctttaacaactggttgcacccggctattaagccgggtgaggattgaaaccaatcatcttacaaaactggaaactgaggcatcta

SEQ ID NO: 1355 - DNA, 107 bp, Artificial Sequence
  Synthetic: homolog screen target set7_F_3
tcaccaaatatatgccttcgtgtgtccaaagtatagttgcacccggctattaagccgggtgaggattgaaactatattcaagtaataacacagcattgcctatacag

SEQ ID NO: 1356 - DNA, 107 bp, Artificial Sequence
  Synthetic: homolog screen target set7_F_4
cacccccaacccccacctttcctaaggacaggtccgttgcacccggctattaagccgggtgaggattgaaacaacccacctcacttactctacatgcagggtccact

SEQ ID NO: 1357 - DNA, 107 bp, Artificial Sequence
  Synthetic: homolog screen target set7_R_1
tcgttagtggcaacactccataaatgatgataacagtttcaatcctcacccggcttaatagccgggtgcaacgtacagcctagcaataaagacacctacaaagtcat

SEQ ID NO: 1358 - DNA, 107 bp, Artificial Sequence
  Synthetic: homolog screen target set7_R_2
tagatgcctcagtttccagttttgtaagatgattggtttcaatcctcacccggcttaatagccgggtgcaaccagttgttaaagcaagttgaggcactgaagatgga

SEQ ID NO: 1359 - DNA, 107 bp, Artificial Sequence
  Synthetic: homolog screen target set7_R_3
ctgtataggcaatgctgtgttattacttgaatatagtttcaatcctcacccggcttaatagccgggtgcaactatactttggacacacgaaggcatatatttggtga

SEQ ID NO: 1360 - DNA, 107 bp, Artificial Sequence
  Synthetic: homolog screen target set7_R_4
agtggaccctgcatgtagagtaagtgaggtgggttgtttcaatcctcacccggcttaatagccgggtgcaacggacctgtccttaggaaaggtgggggttgggggtg

SEQ ID NO: 1361 - DNA, 92 bp, Artificial Sequence
  Synthetic: homolog screen target set8_F_1
tttcaccagctattgtttctaggcccgcagccgttcactgccgtacaggcagcttagaaaactgtttcatgtggcatcttgctatgagcata

SEQ ID NO: 1362 - DNA, 92 bp, Artificial Sequence
  Synthetic: homolog screen target set8_F_2
tatcttaattacttaatagctaaaaagtattagttcactgccgtacaggcagcttagaaataaactaaaaagagaatgtggatctcctgaat

SEQ ID NO: 1363 - DNA, 92 bp, Artificial Sequence
  Synthetic: homolog screen target set8_F_3
caagaagagttggaacccggcatccacaaatcgttcactgccgtacaggcagcttagaaaaccgctatcaccttcaggaagttgttctgagg

SEQ ID NO: 1364 - DNA, 92 bp, Artificial Sequence
  Synthetic: homolog screen target set8_F_4
ctgtagcacaaggtctaaataagtatttattggttcactgccgtacaggcagcttagaaataaataaactcagcctatgggagtgatggaca

SEQ ID NO: 1365 - DNA, 92 bp, Artificial Sequence
  Synthetic: homolog screen target set8_F_5
tcaaagtcttagaccccagccacagggatattgttcactgccgtacaggcagcttagaaattcgtcatccttgtaatccatcagggtcccag

SEQ ID NO: 1366 - DNA, 92 bp, Artificial Sequence
  Synthetic: homolog screen target set8_R_1
tatgctcatagcaagatgccacatgaaacagttttctaagctgcctgtacggcagtgaacggctgcgggcctagaaacaatagctggtgaaa

SEQ ID NO: 1367 - DNA, 92 bp, Artificial Sequence
  Synthetic: homolog screen target set8_R_2
attcaggagatccacattctctttttagtttatttctaagctgcctgtacggcagtgaactaatactttttagctattaagtaattaagata

SEQ ID NO: 1368 - DNA, 92 bp, Artificial Sequence
  Synthetic: homolog screen target set8_R_3
cctcagaacaacttcctgaaggtgatagcggttttctaagctgcctgtacggcagtgaacgatttgtggatgccgggttccaactcttcttg

SEQ ID NO: 1369 - DNA, 92 bp, Artificial Sequence
  Synthetic: homolog screen target set8_R_4
tgtccatcactcccataggctgagtttatttatttctaagctgcctgtacggcagtgaaccaataaatacttatttagaccttgtgctacag

SEQ ID NO: 1370 - DNA, 92 bp, Artificial Sequence
  Synthetic: homolog screen target set8_R_5
ctgggaccctgatggattacaaggatgacgaatttctaagctgcctgtacggcagtgaacaatatccctgtggctggggtctaagactttga

SEQ ID NO: 1371 - DNA, 92 bp, Artificial Sequence
  Synthetic: homolog screen target set8_F_1
tgggactggcagggggagtcagtcctgaataagttcactgccgtgtaggcagctaagaaacgcagcgcagtgcgcactgcggctccagagcg

SEQ ID NO: 1372 - DNA, 92 bp, Artificial Sequence
  Synthetic: homolog screen target set8_F_2
caagaagagttggaacccggcatccacaaatcgttcactgccgtgtaggcagctaagaaaaccgctatcaccttcaggaagttgttctgagg

SEQ ID NO: 1373 - DNA, 92 bp, Artificial Sequence
  Synthetic: homolog screen target set8_F_3
ctgtagcacaaggtctaaataagtatttattggttcactgccgtgtaggcagctaagaaataaataaactcagcctatgggagtgatggaca

SEQ ID NO: 1374 - DNA, 92 bp, Artificial Sequence
  Synthetic: homolog screen target set8_F_4
tgaaagggttagttgagaccattcacaggccagttcactgccgtgtaggcagctaagaaatattgcatatttcttcatgtgaccaaaatatt

SEQ ID NO: 1375 - DNA, 92 bp, Artificial Sequence
  Synthetic: homolog screen target set8_R_1
cgctctggagccgcagtgcgcactgcgctgcgtttcttagctgcctacacggcagtgaacttattcaggactgactccccctgccagtccca

SEQ ID NO: 1376 - DNA, 92 bp, Artificial Sequence
  Synthetic: homolog screen target set8_R_2
cctcagaacaacttcctgaaggtgatagcggttttcttagctgcctacacggcagtgaacgatttgtggatgccgggttccaactcttcttg

SEQ ID NO: 1377 - DNA, 92 bp, Artificial Sequence
  Synthetic: homolog screen target set8_R_3
tgtccatcactcccataggctgagtttatttatttcttagctgcctacacggcagtgaaccaataaatacttatttagaccttgtgctacag

SEQ ID NO: 1378 - DNA, 92 bp, Artificial Sequence
  Synthetic: homolog screen target set8_R_4
aatattttggtcacatgaagaaatatgcaatatttcttagctgcctacacggcagtgaactggcctgtgaatggtctcaactaaccctttca

SEQ ID NO: 1379 - DNA, 92 bp, Artificial Sequence
  Synthetic: homolog screen target set9_F_1
catggccaaaacaacctccttataattaggttgttcaccgccgcacaggcggcttagaaatccctaacctccacctgtcttcctagaggcct

SEQ ID NO: 1380 - DNA, 92 bp, Artificial Sequence
  Synthetic: homolog screen target set9_F_2
ctgtagcacaaggtctaaataagtatttattggttcaccgccgcacaggcggcttagaaataaataaactcagcctatgggagtgatggaca

SEQ ID NO: 1381 - DNA, 92 bp, Artificial Sequence
  Synthetic: homolog screen target set9_F_3
tcaaagtcttagaccccagccacagggatattgttcaccgccgcacaggcggcttagaaattcgtcatccttgtaatccatcagggtcccag

SEQ ID NO: 1382 - DNA, 92 bp, Artificial Sequence
  Synthetic: homolog screen target set9_R_1
aggcctctaggaagacaggtggaggttagggatttctaagccgcctgtgcggcggtgaacaacctaattataaggaggttgttttggccatg

SEQ ID NO: 1383 - DNA, 92 bp, Artificial Sequence
  Synthetic: homolog screen target set9_R_2
tgtccatcactcccataggctgagtttatttatttctaagccgcctgtgcggcggtgaaccaataaatacttatttagaccttgtgctacag

SEQ ID NO: 1384 - DNA, 92 bp, Artificial Sequence
  Synthetic: homolog screen target set9_R_3
ctgggaccctgatggattacaaggatgacgaatttctaagccgcctgtgcggcggtgaacaatatccctgtggctggggtctaagactttga

SEQ ID NO: 1385 - DNA, 92 bp, Artificial Sequence
  Synthetic: homolog screen target set10_F_1
tgggactggcagggggagtcagtcctgaataagttcactgccatataggcagcttagaaacgcagcgcagtgcgcactgcggctccagagcg

SEQ ID NO: 1386 - DNA, 92 bp, Artificial Sequence
  Synthetic: homolog screen target set10_F_2
tttcaccagctattgtttctaggcccgcagccgttcactgccatataggcagcttagaaaactgtttcatgtggcatcttgctatgagcata

SEQ ID NO: 1387 - DNA, 92 bp, Artificial Sequence
  Synthetic: homolog screen target set10_F_3
tatcttaattacttaatagctaaaaagtattagttcactgccatataggcagcttagaaataaactaaaaagagaatgtggatctcctgaat

SEQ ID NO: 1388 - DNA, 92 bp, Artificial Sequence
  Synthetic: homolog screen target set10_F_4
ctgtagcacaaggtctaaataagtatttattggttcactgccatataggcagcttagaaataaataaactcagcctatgggagtgatggaca

SEQ ID NO: 1389 - DNA, 92 bp, Artificial Sequence
  Synthetic: homolog screen target set10_F_5
tcaaagtcttagaccccagccacagggatattgttcactgccatataggcagcttagaaattcgtcatccttgtaatccatcagggtcccag

SEQ ID NO: 1390 - DNA, 92 bp, Artificial Sequence
  Synthetic: homolog screen target set10_F_6
tgaaagggttagttgagaccattcacaggccagttcactgccatataggcagcttagaaatattgcatatttcttcatgtgaccaaaatatt

SEQ ID NO: 1391 - DNA, 92 bp, Artificial Sequence
  Synthetic: homolog screen target set10_R_1
cgctctggagccgcagtgcgcactgcgctgcgtttctaagctgcctatatggcagtgaacttattcaggactgactccccctgccagtccca

SEQ ID NO: 1392 - DNA, 92 bp, Artificial Sequence
  Synthetic: homolog screen target set10_R_2
tatgctcatagcaagatgccacatgaaacagttttctaagctgcctatatggcagtgaacggctgcgggcctagaaacaatagctggtgaaa

SEQ ID NO: 1393 - DNA, 92 bp, Artificial Sequence
  Synthetic: homolog screen target set10_R_3
attcaggagatccacattctctttttagtttatttctaagctgcctatatggcagtgaactaatactttttagctattaagtaattaagata

SEQ ID NO: 1394 - DNA, 92 bp, Artificial Sequence
  Synthetic: homolog screen target set10_R_4
tgtccatcactcccataggctgagtttatttatttctaagctgcctatatggcagtgaaccaataaatacttatttagaccttgtgctacag

SEQ ID NO: 1395 - DNA, 92 bp, Artificial Sequence
  Synthetic: homolog screen target set10_R_5
ctgggaccctgatggattacaaggatgacgaatttctaagctgcctatatggcagtgaacaatatccctgtggctggggtctaagactttga

SEQ ID NO: 1396 - DNA, 92 bp, Artificial Sequence
  Synthetic: homolog screen target set10_R_6
aatattttggtcacatgaagaaatatgcaatatttctaagctgcctatatggcagtgaactggcctgtgaatggtctcaactaaccctttca

SEQ ID NO: 1397 - DNA, 92 bp, Artificial Sequence
  Synthetic: homolog screen target set11_F_1
tgggactggcagggggagtcagtcctgaataagttcactgccgcacaggcagcttagaaacgcagcgcagtgcgcactgcggctccagagcg

SEQ ID NO: 1398 - DNA, 92 bp, Artificial Sequence
  Synthetic: homolog screen target set11_F_2
tgaaagggttagttgagaccattcacaggccagttcactgccgcacaggcagcttagaaatattgcatatttcttcatgtgaccaaaatatt

SEQ ID NO: 1399 - DNA, 92 bp, Artificial Sequence; identical to SEQ ID NO: 1314
  Synthetic: homolog screen target set11_R_1

SEQ ID NO: 1400 - DNA, 92 bp, Artificial Sequence; identical to SEQ ID NO: 1320
  Synthetic: homolog screen target set11_R_2

SEQ ID NO: 1401 - DNA, 52 bp, Artificial Sequence; identical to SEQ ID NO: 475
  Synthetic: homolog screen target set1_ilmn_F_1

SEQ ID NO: 1402 - DNA, 52 bp, Artificial Sequence; identical to SEQ ID NO: 1133
  Synthetic: homolog screen target set1_ilmn_F_2

SEQ ID NO: 1403 - DNA, 52 bp, Artificial Sequence; identical to SEQ ID NO: 1138
  Synthetic: homolog screen target set1_ilmn_F_3

SEQ ID NO: 1404 - DNA, 52 bp, Artificial Sequence; identical to SEQ ID NO: 1150
  Synthetic: homolog screen target set1_ilmn_F_4

SEQ ID NO: 1405 - DNA, 52 bp, Artificial Sequence; identical to SEQ ID NO: 1141
  Synthetic: homolog screen target set1_ilmn_F_5

SEQ ID NO: 1406 - DNA, 50 bp, Artificial Sequence; identical to SEQ ID NO: 1159
  Synthetic: homolog screen target set1_ilmn_F_6

SEQ ID NO: 1407 - DNA, 52 bp, Artificial Sequence; identical to SEQ ID NO: 1186
  Synthetic: homolog screen target set1_ilmn_F_7

SEQ ID NO: 1408 - DNA, 54 bp, Artificial Sequence; identical to SEQ ID NO: 1164
  Synthetic: homolog screen target set1_ilmn_F_8

SEQ ID NO: 1409 - DNA, 48 bp, Artificial Sequence; identical to SEQ ID NO: 476
  Synthetic: homolog screen target set1_ilmn_R_1

SEQ ID NO: 1410 - DNA, 48 bp, Artificial Sequence; identical to SEQ ID NO: 1190
  Synthetic: homolog screen target set1_ilmn_R_2

SEQ ID NO: 1411 - DNA, 48 bp, Artificial Sequence; identical to SEQ ID NO: 1195
  Synthetic: homolog screen target set1_ilmn_R_3

SEQ ID NO: 1412 - DNA, 54 bp, Artificial Sequence; identical to SEQ ID NO: 1207
  Synthetic: homolog screen target set1_ilmn_R_4

SEQ ID NO: 1413 - DNA, 48 bp, Artificial Sequence; identical to SEQ ID NO: 1198
  Synthetic: homolog screen target set1_ilmn_R_5

SEQ ID NO: 1414 - DNA, 48 bp, Artificial Sequence; identical to SEQ ID NO: 1216
  Synthetic: homolog screen target set1_ilmn_R_6

SEQ ID NO: 1415 - DNA, 48 bp, Artificial Sequence; identical to SEQ ID NO: 1243
  Synthetic: homolog screen target set1_ilmn_R_7

SEQ ID NO: 1416 - DNA, 52 bp, Artificial Sequence; identical to SEQ ID NO: 1221
  Synthetic: homolog screen target set1_ilmn_R_8

SEQ ID NO: 1417 - DNA, 52 bp, Artificial Sequence
  Synthetic: homolog screen target set2_ilmn_F_1
cactctttccctacacgacgctcttccgatctaatgcccttctctcttgcct

SEQ ID NO: 1418 - DNA, 52 bp, Artificial Sequence
  Synthetic: homolog screen target set2_ilmn_F_2
cactctttccctacacgacgctcttccgatctacgtcacaaagcgagtgaga

SEQ ID NO: 1419 - DNA, 55 bp, Artificial Sequence
  Synthetic: homolog screen target set2_ilmn_F_3
cactctttccctacacgacgctcttccgatctgatatagcgtctggtatcaaggg

SEQ ID NO: 1420 - DNA, 53 bp, Artificial Sequence
  Synthetic: homolog screen target set2_ilmn_F_4
cactctttccctacacgacgctcttccgatcttttggattagggaggtatggc

SEQ ID NO: 1421 - DNA, 57 bp, Artificial Sequence
  Synthetic: homolog screen target set2_ilmn_F_5
cactctttccctacacgacgctcttccgatctactgtgctttaaacatttgtctgtg

SEQ ID NO: 1422 - DNA, 52 bp, Artificial Sequence
  Synthetic: homolog screen target set2_ilmn_F_6
cactctttccctacacgacgctcttccgatctttccaagattcccagtcacc

SEQ ID NO: 1423 - DNA, 52 bp, Artificial Sequence
  Synthetic: homolog screen target set2_ilmn_F_7
cactctttccctacacgacgctcttccgatctgctgttcaacccacctcact

SEQ ID NO: 1424 - DNA, 52 bp, Artificial Sequence
  Synthetic: homolog screen target set2_ilmn_F_8
cactctttccctacacgacgctcttccgatctccaccacgcctgactaattt

SEQ ID NO: 1425 - DNA, 48 bp, Artificial Sequence
  Synthetic: homolog screen target set2_ilmn_R_1
ggagttcagacgtgtgctcttccgatctgatggaagacaggcttctcg

SEQ ID NO: 1426 - DNA, 48 bp, Artificial Sequence
  Synthetic: homolog screen target set2_ilmn_R_2
ggagttcagacgtgtgctcttccgatctgggcttgtttcttccttcct

SEQ ID NO: 1427 - DNA, 49 bp, Artificial Sequence
  Synthetic: homolog screen target set2_ilmn_R_3
ggagttcagacgtgtgctcttccgatctccctactttccaatcaaggct

SEQ ID NO: 1428 - DNA, 48 bp, Artificial Sequence
  Synthetic: homolog screen target set2_ilmn_R_4
ggagttcagacgtgtgctcttccgatctgggcaagatgagcagagact

SEQ ID NO: 1429 - DNA, 48 bp, Artificial Sequence
  Synthetic: homolog screen target set2_ilmn_R_5
ggagttcagacgtgtgctcttccgatctaagctgttggcctatctgga

SEQ ID NO: 1430 - DNA, 47 bp, Artificial Sequence
  Synthetic: homolog screen target set2_ilmn_R_6
ggagttcagacgtgtgctcttccgatctcatttgtgacagcagcgtg

SEQ ID NO: 1431 - DNA, 47 bp, Artificial Sequence
  Synthetic: homolog screen target set2_ilmn_R_7
ggagttcagacgtgtgctcttccgatctcccagccacagggatattt

SEQ ID NO: 1432 - DNA, 56 bp, Artificial Sequence
  Synthetic: homolog screen target set2_ilmn_R_8
ggagttcagacgtgtgctcttccgatctaaataagtttcacaactatgaacaggtc

SEQ ID NO: 1433 - DNA, 56 bp, Artificial Sequence
  Synthetic: homolog screen target set3_ilmn_F_1
cactctttccctacacgacgctcttccgatctttggacttacagaagagttggaaa

SEQ ID NO: 1434 - DNA, 52 bp, Artificial Sequence
  Synthetic: homolog screen target set3_ilmn_F_2
cactctttccctacacgacgctcttccgatctgtgtatttgggagggaagca

SEQ ID NO: 1435 - DNA, 52 bp, Artificial Sequence
  Synthetic: homolog screen target set3_ilmn_F_3
cactctttccctacacgacgctcttccgatctaaatcgaaatgggattcacg

SEQ ID NO: 1436 - DNA, 52 bp, Artificial Sequence; identical to SEQ ID NO: 1434
  Synthetic: homolog screen target set3_ilmn_R_1

SEQ ID NO: 1437 - DNA, 52 bp, Artificial Sequence; identical to SEQ ID NO: 1435
  Synthetic: homolog screen target set3_ilmn_R_2

SEQ ID NO: 1438 - DNA, 52 bp, Artificial Sequence
  Synthetic: homolog screen target set3_ilmn_R_3
cactctttccctacacgacgctcttccgatctggcgattcacacaactgaaa

SEQ ID NO: 1439 - DNA, 52 bp, Artificial Sequence
  Synthetic: homolog screen target set4_ilmn_F_1
cactctttccctacacgacgctcttccgatctaaagatttgcctgcgtgaat

SEQ ID NO: 1440 - DNA, 52 bp, Artificial Sequence
  Synthetic: homolog screen target set4_ilmn_F_2
cactctttccctacacgacgctcttccgatcttaggtccaagggtagccaag

SEQ ID NO: 1441 - DNA, 52 bp, Artificial Sequence
  Synthetic: homolog screen target set4_ilmn_R_1
cactctttccctacacgacgctcttccgatctatccgtgacactacatgcca

SEQ ID NO: 1442 - DNA, 52 bp, Artificial Sequence
  Synthetic: homolog screen target set4_ilmn_R_2
cactctttccctacacgacgctcttccgatctcccatgctcttaagccactc

SEQ ID NO: 1443 - DNA, 52 bp, Artificial Sequence
  Synthetic: homolog screen target set5_ilmn_F_1
cactctttccctacacgacgctcttccgatctaccatttggccagagtccta

SEQ ID NO: 1444 - DNA, 55 bp, Artificial Sequence
  Synthetic: homolog screen target set5_ilmn_F_2
cactctttccctacacgacgctcttccgatctgcatcaccttcaagaaaggtaca

SEQ ID NO: 1445 - DNA, 52 bp, Artificial Sequence; identical to SEQ ID NO: 1438
  Synthetic: homolog screen target set5_ilmn_F_3

SEQ ID NO: 1446 - DNA, 52 bp, Artificial Sequence; identical to SEQ ID NO: 1439
  Synthetic: homolog screen target set5_ilmn_F_4

SEQ ID NO: 1447 - DNA, 52 bp, Artificial Sequence; identical to SEQ ID NO: 1442
  Synthetic: homolog screen target set5_ilmn_F_5

SEQ ID NO: 1448 - DNA, 52 bp, Artificial Sequence; identical to SEQ ID NO: 1443
  Synthetic: homolog screen target set5_ilmn_F_6

SEQ ID NO: 1449 - DNA, 52 bp, Artificial Sequence
  Synthetic: homolog screen target set5_ilmn_F_7
cactctttccctacacgacgctcttccgatctaggcttgtccctggtaacct

SEQ ID NO: 1450 - DNA, 52 bp, Artificial Sequence; identical to SEQ ID NO: 1440
  Synthetic: homolog screen target set5_ilmn_R_1

SEQ ID NO: 1451 - DNA, 52 bp, Artificial Sequence; identical to SEQ ID NO: 1441
  Synthetic: homolog screen target set5_ilmn_R_2

SEQ ID NO: 1452 - DNA, 52 bp, Artificial Sequence; identical to SEQ ID NO: 1443
  Synthetic: homolog screen target set5_ilmn_R_3

SEQ ID NO: 1453 - DNA, 52 bp, Artificial Sequence
  Synthetic: homolog screen target set5_ilmn_R_4
cactctttccctacacgacgctcttccgatctttgttcccagtgttggttga

SEQ ID NO: 1454 - DNA, 57 bp, Artificial Sequence
  Synthetic: homolog screen target set5_ilmn_R_5
cactctttccctacacgacgctcttccgatcttggatttcatattacagaggcattt

SEQ ID NO: 1455 - DNA, 52 bp, Artificial Sequence
  Synthetic: homolog screen target set5_ilmn_R_6
cactctttccctacacgacgctcttccgatctgtggactagcacttggctcc

SEQ ID NO: 1456 - DNA, 53 bp, Artificial Sequence
  Synthetic: homolog screen target set5_ilmn_R_7
cactctttccctacacgacgctcttccgatctttggcacatggtaaacactca

SEQ ID NO: 1457 - DNA, 52 bp, Artificial Sequence; identical to SEQ ID NO: 1186
  Synthetic: homolog screen target set6_ilmn_F_1

SEQ ID NO: 1458 - DNA, 52 bp, Artificial Sequence
  Synthetic: homolog screen target set6_ilmn_F_2
cactctttccctacacgacgctcttccgatctggaaatcgaccaaagacgag

SEQ ID NO: 1459 - DNA, 52 bp, Artificial Sequence; identical to SEQ ID NO: 1455
  Synthetic: homolog screen target set6_ilmn_F_3

SEQ ID NO: 1460 - DNA, 53 bp, Artificial Sequence; identical to SEQ ID NO: 1456
  Synthetic: homolog screen target set6_ilmn_F_4

SEQ ID NO: 1461 - DNA, 52 bp, Artificial Sequence
  Synthetic: homolog screen target set6_ilmn_R_1
cactctttccctacacgacgctcttccgatctcagaagccctttgagagtgg

SEQ ID NO: 1462 - DNA, 52 bp, Artificial Sequence
  Synthetic: homolog screen target set6_ilmn_R_2
cactctttccctacacgacgctcttccgatctaggcaaatagaattgggctg

SEQ ID NO: 1463 - DNA, 53 bp, Artificial Sequence; identical to SEQ ID NO: 1456
  Synthetic: homolog screen target set6_ilmn_R_3

SEQ ID NO: 1464 - DNA, 52 bp, Artificial Sequence; identical to SEQ ID NO: 1186
  Synthetic: homolog screen target set6_ilmn_R_4

SEQ ID NO: 1465 - DNA, 52 bp, Artificial Sequence; identical to SEQ ID NO: 1458
  Synthetic: homolog screen target set7_ilmn_F_1

SEQ ID NO: 1466 - DNA, 52 bp, Artificial Sequence; identical to SEQ ID NO: 1453
  Synthetic: homolog screen target set7_ilmn_F_2

SEQ ID NO: 1467 - DNA, 57 bp, Artificial Sequence; identical to SEQ ID NO: 1454
  Synthetic: homolog screen target set7_ilmn_F_3

SEQ ID NO: 1468 - DNA, 53 bp, Artificial Sequence; identical to SEQ ID NO: 1456
  Synthetic: homolog screen target set7_ilmn_F_4

SEQ ID NO: 1469 - DNA, 52 bp, Artificial Sequence; identical to SEQ ID NO: 1186
  Synthetic: homolog screen target set7_ilmn_R_1

SEQ ID NO: 1470 - DNA, 52 bp, Artificial Sequence; identical to SEQ ID NO: 1461
  Synthetic: homolog screen target set7_ilmn_R_2

SEQ ID NO: 1471 - DNA, 52 bp, Artificial Sequence; identical to SEQ ID NO: 1458
  Synthetic: homolog screen target set7_ilmn_R_3

SEQ ID NO: 1472 - DNA, 52 bp, Artificial Sequence; identical to SEQ ID NO: 1461
  Synthetic: homolog screen target set7_ilmn_R_4

SEQ ID NO: 1473 - DNA, 49 bp, Artificial Sequence
  Synthetic: homolog screen target set8_ilmn_F_1
ggagttcagacgtgtgctcttccgatctgcagggagtaaaccaacaaca

SEQ ID NO: 1474 - DNA, 48 bp, Artificial Sequence
  Synthetic: homolog screen target set8_ilmn_F_2
ggagttcagacgtgtgctcttccgatctggatctggtgatgagaggga

SEQ ID NO: 1475 - DNA, 49 bp, Artificial Sequence
  Synthetic: homolog screen target set8_ilmn_F_3
ggagttcagacgtgtgctcttccgatctccattcggctctgacagataa

SEQ ID NO: 1476 - DNA, 48 bp, Artificial Sequence; identical to SEQ ID NO: 1474
  Synthetic: homolog screen target set8_ilmn_F_4

SEQ ID NO: 1477 - DNA, 49 bp, Artificial Sequence; identical to SEQ ID NO: 1475
  Synthetic: homolog screen target set8_ilmn_F_5

SEQ ID NO: 1478 - DNA, 48 bp, Artificial Sequence
  Synthetic: homolog screen target set8_ilmn_R_1
ggagttcagacgtgtgctcttccgatctcaggtagtgtgcagcctcaa

SEQ ID NO: 1479 - DNA, 48 bp, Artificial Sequence
  Synthetic: homolog screen target set8_ilmn_R_2
ggagttcagacgtgtgctcttccgatctggttcagaacttgagcaggg

SEQ ID NO: 1480 - DNA, 54 bp, Artificial Sequence; identical to SEQ ID NO: 1207
  Synthetic: homolog screen target set8_ilmn_R_3

SEQ ID NO: 1481 - DNA, 49 bp, Artificial Sequence
  Synthetic: homolog screen target set8_ilmn_R_4
ggagttcagacgtgtgctcttccgatctgctcttcgtagtggtgcattt

SEQ ID NO: 1482 - DNA, 49 bp, Artificial Sequence
  Synthetic: homolog screen target set8_ilmn_R_5
ggagttcagacgtgtgctcttccgatctaagaaatttgcccaaggtcat

SEQ ID NO: 1483 - DNA, 48 bp, Artificial Sequence
  Synthetic: homolog screen target set8_ilmn_F_1
ggagttcagacgtgtgctcttccgatcttggaacacaatgggttgaga

SEQ ID NO: 1484 - DNA, 50 bp, Artificial Sequence
  Synthetic: homolog screen target set8_ilmn_F_2
ggagttcagacgtgtgctcttccgatcttgggttcgtttacacaagtcaa

SEQ ID NO: 1485 - DNA, 48 bp, Artificial Sequence; identical to SEQ ID NO: 1478
  Synthetic: homolog screen target set8_ilmn_F_3

SEQ ID NO: 1486 - DNA, 48 bp, Artificial Sequence; identical to SEQ ID NO: 1479
  Synthetic: homolog screen target set8_ilmn_F_4

SEQ ID NO: 1487 - DNA, 49 bp, Artificial Sequence; identical to SEQ ID NO: 1482
  Synthetic: homolog screen target set8_ilmn_R_1

SEQ ID NO: 1488 - DNA, 48 bp, Artificial Sequence; identical to SEQ ID NO: 1483
  Synthetic: homolog screen target set8_ilmn_R_2

SEQ ID NO: 1489 - DNA, 48 bp, Artificial Sequence
  Synthetic: homolog screen target set8_ilmn_R_3
ggagttcagacgtgtgctcttccgatctgcatcaaagccaggaatctc

SEQ ID NO: 1490 - DNA, 54 bp, Artificial Sequence; identical to SEQ ID NO: 1207
  Synthetic: homolog screen target set8_ilmn_R_4

SEQ ID NO: 1491 - DNA, 49 bp, Artificial Sequence; identical to SEQ ID NO: 1481
  Synthetic: homolog screen target set9_ilmn_F_1

SEQ ID NO: 1492 - DNA, 48 bp, Artificial Sequence; identical to SEQ ID NO: 1483
  Synthetic: homolog screen target set9_ilmn_F_2

SEQ ID NO: 1493 - DNA, 48 bp, Artificial Sequence
  Synthetic: homolog screen target set9_ilmn_F_3
ggagttcagacgtgtgctcttccgatctacaagcccgtgaagatgagt

SEQ ID NO: 1494 - DNA, 51 bp, Artificial Sequence
  Synthetic: homolog screen target set9_ilmn_R_1
ggagttcagacgtgtgctcttccgatctgccaggtaagaggactttaggaa

SEQ ID NO: 1495 - DNA, 48 bp, Artificial Sequence
  Synthetic: homolog screen target set9_ilmn_R_2
ggagttcagacgtgtgctcttccgatcttctctgatgaagacccaggc

SEQ ID NO: 1496 - DNA, 48 bp, Artificial Sequence
  Synthetic: homolog screen target set9_ilmn_R_3
ggagttcagacgtgtgctcttccgatctttcccgtgtcacatagcgta

SEQ ID NO: 1497 - DNA, 48 bp, Artificial Sequence; identical to SEQ ID NO: 1243
  Synthetic: homolog screen target set10_ilmnF_1

SEQ ID NO: 1498 - DNA, 48 bp, Artificial Sequence
  Synthetic: homolog screen target set10_ilmnF_2
ggagttcagacgtgtgctcttccgatctagcacgtttagaatctggcg

SEQ ID NO: 1499 - DNA, 48 bp, Artificial Sequence; identical to SEQ ID NO: 1495
  Synthetic: homolog screen target set10_ilmnF_3

SEQ ID NO: 1500 - DNA, 48 bp, Artificial Sequence; identical to SEQ ID NO: 1496
  Synthetic: homolog screen target set10_ilmnF_4

SEQ ID NO: 1501 - DNA, 50 bp, Artificial Sequence
  Synthetic: homolog screen target set10_ilmnF_5
ggagttcagacgtgtgctcttccgatctaggctagaaatacgtggcaaag

SEQ ID NO: 1502 - DNA, 48 bp, Artificial Sequence
  Synthetic: homolog screen target set10_ilmnF_6
ggagttcagacgtgtgctcttccgatcttggcttcacagtgagcgtag

SEQ ID NO: 1503 - DNA, 48 bp, Artificial Sequence; identical to SEQ ID NO: 1496
  Synthetic: homolog screen target set10_ilmnR_1

SEQ ID NO: 1504 - DNA, 48 bp, Artificial Sequence; identical to SEQ ID NO: 1243
  Synthetic: homolog screen target set10_ilmnR_2

SEQ ID NO: 1505 - DNA, 48 bp, Artificial Sequence; identical to SEQ ID NO: 1498
  Synthetic: homolog screen target set10_ilmnR_3

SEQ ID NO: 1506 - DNA, 48 bp, Artificial Sequence; identical to SEQ ID NO: 1493
  Synthetic: homolog screen target set10_ilmnR_4

SEQ ID NO: 1507 - DNA, 51 bp, Artificial Sequence; identical to SEQ ID NO: 1494
  Synthetic: homolog screen target set10_ilmnR_5

SEQ ID NO: 1508 - DNA, 48 bp, Artificial Sequence; identical to SEQ ID NO: 1496
  Synthetic: homolog screen target set10_ilmnR_6

SEQ ID NO: 1509 - DNA, 48 bp, Artificial Sequence; identical to SEQ ID NO: 1243
  Synthetic: homolog screen target set11_ilmnF_1

SEQ ID NO: 1510 - DNA, 50 bp, Artificial Sequence; identical to SEQ ID NO: 1501
  Synthetic: homolog screen target set11_ilmnF_2

SEQ ID NO: 1511 - DNA, 48 bp, Artificial Sequence; identical to SEQ ID NO: 1498
  Synthetic: homolog screen target set11_ilmnR_1

SEQ ID NO: 1512 - DNA, 50 bp, Artificial Sequence; identical to SEQ ID NO: 1501
  Synthetic: homolog screen target set11_ilmnR_2

SEQ ID NO: 1513 - DNA, 82 bp, Artificial Sequence
  Synthetic: oCB5714
gagggcctatttcccatgattccttcatatttgcatatacgatacaaggctgttagagagataattggaattaatttgactg

SEQ ID NO: 1514 - DNA, 200 bp, Artificial Sequence
  Synthetic: oCB5715
gctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacac

SEQ ID NO: 1515 - DNA, 20 bp, Artificial Sequence
  Synthetic: oCB5717
gccccagctggttctttccg

SEQ ID NO: 1516 - DNA, 200 bp, Artificial Sequence
  Synthetic: Hsa345_Pseud
cccagctggttctttccgaaaaaaacggttcatccccgcaggtgcggggaacacgtactcgtcggcatccaccacgtcgtccatgtcggttcatccccgcaggtgcggggaacacagaatgcatttgccaagtcctacagactccaacggttcatccccgcaggtgcggggaacacggtgtttcgtcctttccacaagat

SEQ ID NO: 1517 - DNA, 200 bp, Artificial Sequence
  Synthetic: Hsa346_Pseud
cccagctggttctttccgaaaaaaacggttcatccccgcaggtgcggggaacacccgcttcccctctcaggccagcttccctaaggcggttcatccccgcaggtgcggggaacacgggtccagtggatgccacagcccagcttggcccggttcatccccgcaggtgcggggaacacggtgtttcgtcctttccacaagat

SEQ ID NO: 1518 - DNA, 200 bp, Artificial Sequence; identical to SEQ ID NO: 1517
  Synthetic: Hsa347_Pseud

SEQ ID NO: 1519 - DNA, 200 bp, Artificial Sequence
  Synthetic: Hsa348_Pseud
cccagctggttctttccgaaaaaaacggttcatccccgcaggtgcggggaacacaagtgcttggtgagggcttccagcagctcctgcggttcatccccgcaggtgcggggaacaccactgtgcccatgctgaaagaggcctgccgggcggttcatccccgcaggtgcggggaacacggtgtttcgtcctttccacaagat

SEQ ID NO: 1520 - DNA, 200 bp, Artificial Sequence
  Synthetic: Hsa349_Pseud
cccagctggttctttccgaaaaaaacggttcatccccgcaggtgcggggaacacacacatgcttttaagaaacgtcaatgtatatccggttcatccccgcaggtgcggggaacacgcatacagcattcaaaaccagtgctggaatagcggttcatccccgcaggtgcggggaacacggtgtttcgtcctttccacaagat

SEQ ID NO: 1521 - DNA, 200 bp, Artificial Sequence
  Synthetic: Hsa350_Pseud
cccagctggttctttccgaaaaaaacggttcatccccgcaggtgcggggaacactgctgggaattccaaccatccaatcggacaagcggttcatccccgcaggtgcggggaacacaaatgttattcatgcttcttattttaaaagtgcggttcatccccgcaggtgcggggaacacggtgtttcgtcctttccacaagat

SEQ ID NO: 1522 - DNA, 200 bp, Artificial Sequence
  Synthetic: Hsa351_Pseud
cccagctggttctttccgaaaaaaacggttcatccccgcaggtgcggggaacactctaaatataaaagaggactgcaatgccatggcggttcatccccgcaggtgcggggaacacggctcaggggcctccaggttcacctcagtcttcggttcatccccgcaggtgcggggaacacggtgtttcgtcctttccacaagat

SEQ ID NO: 1523 - DNA, 200 bp, Artificial Sequence
  Synthetic: Hsa352_Pseud
cccagctggttctttccgaaaaaaacggttcatccccgcaggtgcggggaacacgcatgtttggtaaaaatgtttttgtgagagttcggttcatccccgcaggtgcggggaacacacttaaaaatttttaaatgcccttaaaagtgacggttcatccccgcaggtgcggggaacacggtgtttcgtcctttccacaagat

SEQ ID NO: 1524 - DNA, 200 bp, Artificial Sequence
  Synthetic: Hsa353_Pseud
cccagctggttctttccgaaaaaaacggttcatccccgcaggtgcggggaacacctggctgcacaaacaccttctcgtttcagagtcggttcatccccgcaggtgcggggaacacgtgttttatttttcatgtagtgtgctccaccacggttcatccccgcaggtgcggggaacacggtgtttcgtcctttccacaagat

SEQ ID NO: 1525 - DNA, 200 bp, Artificial Sequence
  Synthetic: Hsa354_Pseud
cccagctggttctttccgaaaaaaacggttcatccccgcaggtgcggggaacacagtcacctgaattttctggtcatccaactcttcggttcatccccgcaggtgcggggaacacgtgcagatacacaccccgcaggaacatccctccggttcatccccgcaggtgcggggaacacggtgtttcgtcctttccacaagat

SEQ ID NO: 1526 - DNA, 200 bp, Artificial Sequence
  Synthetic: Hsa355_Pseud
cccagctggttctttccgaaaaaaacggttcatccccgcaggtgcggggaacactggcatgaggagggggaagcttttttgaatcgcggttcatccccgcaggtgcggggaacacaatgaattgatttccataaagcaaatcttactcggttcatccccgcaggtgcggggaacacggtgtttcgtcctttccacaagat

SEQ ID NO: 1527 - DNA, 200 bp, Artificial Sequence
  Synthetic: Hsa356_Pseud
cccagctggttctttccgaaaaaaacggttcatccccgcaggtgcggggaacacgcagcctctagagccttcttgctttcattttccggttcatccccgcaggtgcggggaacactagctttgggtttcaggcacttcagtaagagacggttcatccccgcaggtgcggggaacacggtgtttcgtcctttccacaagat

SEQ ID NO: 1528 - DNA, 200 bp, Artificial Sequence
  Synthetic: Hsa357_Pseud
cccagctggttctttccgaaaaaaacggttcatccccgcaggtgcggggaacacttttgtttcctgaaattatcacatctccatcacggttcatccccgcaggtgcggggaacactctcttgcagtcgtcagcctgaacataacatccggttcatccccgcaggtgcggggaacacggtgtttcgtcctttccacaagat

SEQ ID NO: 1529 - DNA, 200 bp, Artificial Sequence; identical to SEQ ID NO: 1525
  Synthetic: Hsa358_Pseud

SEQ ID NO: 1530 - DNA, 200 bp, Artificial Sequence
  Synthetic: Hsa359_Pseud
cccagctggttctttccgaaaaaaacggttcatccccgcaggtgcggggaacaccagacttttataatctccagtggcatctttcccggttcatccccgcaggtgcggggaacactattcatctttgccagtctatcaaatctgctgcggttcatccccgcaggtgcggggaacacggtgtttcgtcctttccacaagat

SEQ ID NO: 1531 - DNA, 200 bp, Artificial Sequence
  Synthetic: Hsa360_Pseud
cccagctggttctttccgaaaaaaacggttcatccccgcaggtgcggggaacacgatgcagaaaaggtagactggggccactgggtcggttcatccccgcaggtgcggggaacaccttcctggcagggatgtcagacccagccttggcggttcatccccgcaggtgcggggaacacggtgtttcgtcctttccacaagat

SEQ ID NO: 1532 - DNA, 200 bp, Artificial Sequence
  Synthetic: Hsa361_Pseud
cccagctggttctttccgaaaaaaacggttcatccccgcaggtgcggggaacaccgcaatacaggaacccccaggggaaagatgagcggttcatccccgcaggtgcggggaacacaaaatacagggaagaaacggtaaaaatcaaagcggttcatccccgcaggtgcggggaacacggtgtttcgtcctttccacaagat

SEQ ID NO: 1533 - DNA, 200 bp, Artificial Sequence
  Synthetic: Hsa362_Pseud
cccagctggttctttccgaaaaaaacggttcatccccgcaggtgcggggaacacacacattcggctccctggagccagactctggtcggttcatccccgcaggtgcggggaacaccgattgttcctgggagcttctccagaccttggcggttcatccccgcaggtgcggggaacacggtgtttcgtcctttccacaagat

SEQ ID NO: 1534 - DNA, 200 bp, Artificial Sequence
  Synthetic: Hsa363_Pseud
cccagctggttctttccgaaaaaaacggttcatccccgcaggtgcggggaacaccctccttcccaggtcctccagcccttctgcgacggttcatccccgcaggtgcggggaacactgctctccggccgggccaacgcgcggggcctgcggttcatccccgcaggtgcggggaacacggtgtttcgtcctttccacaagat

SEQ ID NO: 1535 - DNA, 200 bp, Artificial Sequence
  Synthetic: Hsa364_Pseud
cccagctggttctttccgaaaaaaacggttcatccccgcaggtgcggggaacacccgtgaaatgggttgtgggccaaagctttcttcggttcatccccgcaggtgcggggaacactgtatttttcagtaatggcaatgcagatgcagcggttcatccccgcaggtgcggggaacacggtgtttcgtcctttccacaagat

SEQ ID NO: 1536 - DNA, 200 bp, Artificial Sequence
  Synthetic: Hsa365_Pseud
cccagctggttctttccgaaaaaaacggttcatccccgcaggtgcggggaacactctccctagagatataatttagatattcctatcggttcatccccgcaggtgcggggaacacggtgtaaccactgccaataggctgtttctatgcggttcatccccgcaggtgcggggaacacggtgtttcgtcctttccacaagat

SEQ ID NO: 1537 - DNA, 200 bp, Artificial Sequence
  Synthetic: Hsa366_Pseud
cccagctggttctttccgaaaaaaacggttcatccccgcaggtgcggggaacacggagttgccatgattttttcagtaaagggcatcggttcatccccgcaggtgcggggaacacatttatctcctttcttcaggcttccagctggtcggttcatccccgcaggtgcggggaacacggtgtttcgtcctttccacaagat

SEQ ID NO: 1538 - DNA, 200 bp, Artificial Sequence
  Synthetic: Hsa367_Pseud
cccagctggttctttccgaaaaaaacggttcatccccgcaggtgcggggaacaccttctcaccgtgttttctcttggtaactttcccggttcatccccgcaggtgcggggaacacgactgggctccttggtggatgagtttaaggagcggttcatccccgcaggtgcggggaacacggtgtttcgtcctttccacaagat

SEQ ID NO: 1539 - DNA, 200 bp, Artificial Sequence
  Synthetic: Hsa368_Pseud
cccagctggttctttccgaaaaaaacggttcatccccgcaggtgcggggaacactccctctcctgcagcagcctccgcagcgtgcgcggttcatccccgcaggtgcggggaacacttgctgctggtggtggccctggggatcggcctcggttcatccccgcaggtgcggggaacacggtgtttcgtcctttccacaagat

SEQ ID NO: 1540 - DNA, 200 bp, Artificial Sequence
  Synthetic: Hsa369_Pseud
cccagctggttctttccgaaaaaaacggttcatccccgcaggtgcggggaacacacctcagagtatgttctgctgcttgaactttacggttcatccccgcaggtgcggggaacacatgacaaggtggaactagccaatatgaatagacggttcatccccgcaggtgcggggaacacggtgtttcgtcctttccacaagat

SEQ ID NO: 1541 - DNA, 200 bp, Artificial Sequence
  Synthetic: Hsa370_Pseud
cccagctggttctttccgaaaaaaacggttcatccccgcaggtgcggggaacaccatttacctcagagtatgttctgctgcttgaacggttcatccccgcaggtgcggggaacacaaggtggaactagccaatatgaatagacttttcggttcatccccgcaggtgcggggaacacggtgtttcgtcctttccacaagat

SEQ ID NO: 1542 - DNA, 200 bp, Artificial Sequence
  Synthetic: Hsa371_Pseud
cccagctggttctttccgaaaaaaacggttcatccccgcaggtgcggggaacacatactttatcaaattgtaaaattttataaaaccggttcatccccgcaggtgcggggaacacaaatgaaatgcagtttttcaaaaataaatttccggttcatccccgcaggtgcggggaacacggtgtttcgtcctttccacaagat

SEQ ID NO: 1543 - DNA, 200 bp, Artificial Sequence
  Synthetic: Hsa372_Pseud
cccagctggttctttccgaaaaaaacggttcatccccgcaggtgcggggaacacgtaaatatttttaaaattcactgaatttttgtcggttcatccccgcaggtgcggggaacacatcagtaagatcataagcagtgatcgagatctcggttcatccccgcaggtgcggggaacacggtgtttcgtcctttccacaagat

SEQ ID NO: 1544 - DNA, 200 bp, Artificial Sequence
  Synthetic: Hsa373_Pseud
cccagctggttctttccgaaaaaaacggttcatccccgcaggtgcggggaacacctattcaacctccttacatgtcaggtccactgcggttcatccccgcaggtgcggggaacacgtgctgcagcagcacttcaggaacctggaggccggttcatccccgcaggtgcggggaacacggtgtttcgtcctttccacaagat

SEQ ID NO: 1545 - DNA, 200 bp, Artificial Sequence
  Synthetic: Hsa374_Pseud
cccagctggttctttccgaaaaaaacggttcatccccgcaggtgcggggaacacccttcacacaaaagaacagtatatagtacaaacggttcatccccgcaggtgcggggaacacggtgatggtgtagccctcccactttgctgttccggttcatccccgcaggtgcggggaacacggtgtttcgtcctttccacaagat

SEQ ID NO: 1546 - DNA, 200 bp, Artificial Sequence
  Synthetic: Hsa375_Pseud
cccagctggttctttccgaaaaaaacggttcatccccgcaggtgcggggaacacgtagagcagcatccagaaagtctgttattcctcggttcatccccgcaggtgcggggaacacaacactgataccccaaaataggattttccttccggttcatccccgcaggtgcggggaacacggtgtttcgtcctttccacaagat

SEQ ID NO: 1547 - DNA, 200 bp, Artificial Sequence
  Synthetic: Hsa376_Pseud
cccagctggttctttccgaaaaaaacggttcatccccgcaggtgcggggaacactcccagcatgctctggggaggcggctctggctcggttcatccccgcaggtgcggggaacacaaataaacaaaagaaagaaaagaaaaatagcccggttcatccccgcaggtgcggggaacacggtgtttcgtcctttccacaagat

SEQ ID NO: 1548 - DNA, 200 bp, Artificial Sequence
  Synthetic: Hsa377_Pseud
cccagctggttctttccgaaaaaaacggttcatccccgcaggtgcggggaacaccattcggctccctggagccagactctggtcttcggttcatccccgcaggtgcggggaacacgccatcgattgttcctgggagcttctccagaccggttcatccccgcaggtgcggggaacacggtgtttcgtcctttccacaagat

SEQ ID NO: 1549 - DNA, 200 bp, Artificial Sequence
  Synthetic: Hsa378_Pseud
cccagctggttctttccgaaaaaaacggttcatccccgcaggtgcggggaacacaagtcacgcgcagtagaacatgaacggcgcagcggttcatccccgcaggtgcggggaacacgatcataaagacactgttctcccttcaagttccggttcatccccgcaggtgcggggaacacggtgtttcgtcctttccacaagat

SEQ ID NO: 1550 - DNA, 200 bp, Artificial Sequence
  Synthetic: Hsa379_Pseud
cccagctggttctttccgaaaaaaacggttcatccccgcaggtgcggggaacacagtttggtgcgaacgccattctgggggtgtcccggttcatccccgcaggtgcggggaacacaagtcagcgatgtggcggtacagggggacccccggttcatccccgcaggtgcggggaacacggtgtttcgtcctttccacaagat

SEQ ID NO: 1551 - DNA, 200 bp, Artificial Sequence
  Synthetic: Hsa380_Pseud
cccagctggttctttccgaaaaaaacggttcatccccgcaggtgcggggaacacctaaaggtaccctcagtgtcaatgtacatggccggttcatccccgcaggtgcggggaacacttcatttctactgttgtttttgttctctatagcggttcatccccgcaggtgcggggaacacggtgtttcgtcctttccacaagat

SEQ ID NO: 1552 - DNA, 200 bp, Artificial Sequence
  Synthetic: Hsa381_Pseud
cccagctggttctttccgaaaaaaacggttcatccccgcaggtgcggggaacacacttggaaagggtttatcatacctcatagtcgcggttcatccccgcaggtgcggggaacacctttaaaacatatttttctttgttttaagccgcggttcatccccgcaggtgcggggaacacggtgtttcgtcctttccacaagat

SEQ ID NO: 1553 - DNA, 200 bp, Artificial Sequence
  Synthetic: Hsa382_Pseud
cccagctggttctttccgaaaaaaacggttcatccccgcaggtgcggggaacaccataaataagtttccaggctaaaaaaactatccggttcatccccgcaggtgcggggaacactagttttgagatgctaggattatactgtgattcggttcatccccgcaggtgcggggaacacggtgtttcgtcctttccacaagat

SEQ ID NO: 1554 - DNA, 200 bp, Artificial Sequence
  Synthetic: Hsa383_Pseud
cccagctggttctttccgaaaaaaacggttcatccccgcaggtgcggggaacacaggagtcacctgaattttctggtcatccaactcggttcatccccgcaggtgcggggaacacgtgcagatacacaccccgcaggaacatccctccggttcatccccgcaggtgcggggaacacggtgtttcgtcctttccacaagat

SEQ ID NO: 1555 - DNA, 200 bp, Artificial Sequence
  Synthetic: Hsa384_Pseud
cccagctggttctttccgaaaaaaacggttcatccccgcaggtgcggggaacaccccaaccccaggcagcctctagagccttcttgcggttcatccccgcaggtgcggggaacacggtttcaggcacttcagtaagagactttcccccggttcatccccgcaggtgcggggaacacggtgtttcgtcctttccacaagat

SEQ ID NO: 1556 - DNA, 200 bp, Artificial Sequence
  Synthetic: Hsa385_Pseud
cccagctggttctttccgaaaaaaacggttcatccccgcaggtgcggggaacactttcatcccagggttctctcctctcctcacagcggttcatccccgcaggtgcggggaacacgccaaatccttgcgtagcccgaagcggtggcacggttcatccccgcaggtgcggggaacacggtgtttcgtcctttccacaagat

SEQ ID NO: 1557 - DNA, 200 bp, Artificial Sequence
  Synthetic: Hsa386_Pseud
cccagctggttctttccgaaaaaaacggttcatccccgcaggtgcggggaacacccccagcgcctatctttctcctttggggaccacggttcatccccgcaggtgcggggaacaccccgatccactagggatgcactcaccgctggccggttcatccccgcaggtgcggggaacacggtgtttcgtcctttccacaagat

SEQ ID NO: 1558 - DNA, 200 bp, Artificial Sequence
  Synthetic: Hsa387_Pseud
cccagctggttctttccgaaaaaaacggttcatccccgcaggtgcggggaacacgttttcactccagctaacacagatgtaaaagacggttcatccccgcaggtgcggggaacactggtcagtcttttatatctgaaaaatgtgtaacggttcatccccgcaggtgcggggaacacggtgtttcgtcctttccacaagat

SEQ ID NO: 1559 - DNA, 200 bp, Artificial Sequence
  Synthetic: Hsa388_Pseud
cccagctggttctttccgaaaaaaacggttcatccccgcaggtgcggggaacacgttgtaggattctacattaattctcttgtgcccggttcatccccgcaggtgcggggaacacttaaagcaatttaaaaaaccaattcaggcttgcggttcatccccgcaggtgcggggaacacggtgtttcgtcctttccacaagat

SEQ ID NO: 1560 - DNA, 200 bp, Artificial Sequence
  Synthetic: Hsa389_Pseud
cccagctggttctttccgaaaaaaacggttcatccccgcaggtgcggggaacacctcctttccttagtggtgtctatcgaagatcccggttcatccccgcaggtgcggggaacaccccactacctggattcctgcactggctgtgaacggttcatccccgcaggtgcggggaacacggtgtttcgtcctttccacaagat

SEQ ID NO: 1561 - DNA, 200 bp, Artificial Sequence
  Synthetic: Hsa390_Pseud
cccagctggttctttccgaaaaaaacggttcatccccgcaggtgcggggaacacgtcatcggcatggacgtagcggcctccgagttcggttcatccccgcaggtgcggggaacacggcgagatgtacctgctggggtcatcgggagacggttcatccccgcaggtgcggggaacacggtgtttcgtcctttccacaagat

SEQ ID NO: 1562 - DNA, 200 bp, Artificial Sequence
  Synthetic: Hsa391_Pseud
cccagctggttctttccgaaaaaaacggttcatccccgcaggtgcggggaacactaaccgtgaaatgggttgtgggccaaagctttcggttcatccccgcaggtgcggggaacactgtatttttcagtaatggcaatgcagatgcagcggttcatccccgcaggtgcggggaacacggtgtttcgtcctttccacaagat

SEQ ID NO: 1563 - DNA, 200 bp, Artificial Sequence
  Synthetic: Hsa392_Pseud
cccagctggttctttccgaaaaaaacggttcatccccgcaggtgcggggaacacgggttgtcttcattggtgaacagcatgatcctcggttcatccccgcaggtgcggggaacacctcagtgaagtgctgtgggtctgtgccaacctcggttcatccccgcaggtgcggggaacacggtgtttcgtcctttccacaagat

SEQ ID NO: 1564 - DNA, 200 bp, Artificial Sequence
  Synthetic: Hsa393_Pseud
cccagctggttctttccgaaaaaaacggttcatccccgcaggtgcggggaacacttagaaaaataacagtggagagcacagcttcacggttcatccccgcaggtgcggggaacactcctttcccctgtgtgggataatctctcccagcggttcatccccgcaggtgcggggaacacggtgtttcgtcctttccacaagat

SEQ ID NO: 1565 - DNA, 200 bp, Artificial Sequence
  Synthetic: Hsa394_Pseud
cccagctggttctttccgaaaaaaacggttcatccccgcaggtgcggggaacacagttctagtctctctggggccacacagaaactcggttcatccccgcaggtgcggggaacacagctccaagacctggtcccatggtcctgcctacggttcatccccgcaggtgcggggaacacggtgtttcgtcctttccacaagat

SEQ ID NO: 1566 - DNA, 200 bp, Artificial Sequence
  Synthetic: Hsa395_Pseud
cccagctggttctttccgaaaaaaacggttcatccccgcaggtgcggggaacacggagggtgctttgttccttctgcagagtcgtgcggttcatccccgcaggtgcggggaacacggggccggcccaggcctagggtgtggaggagccggttcatccccgcaggtgcggggaacacggtgtttcgtcctttccacaagat

SEQ ID NO: 1567 - DNA, 200 bp, Artificial Sequence
  Synthetic: Hsa396_Pseud
cccagctggttctttccgaaaaaaacggttcatccccgcaggtgcggggaacacgctctgcaaccaggagcccagtggggagggtgcggttcatccccgcaggtgcggggaacacggaggagccttgccatcgggcttcctgtctctcggttcatccccgcaggtgcggggaacacggtgtttcgtcctttccacaagat

SEQ ID NO: 1568 - DNA, 200 bp, Artificial Sequence
  Synthetic: Hsa397_Pseud
cccagctggttctttccgaaaaaaacggttcatccccgcaggtgcggggaacacattaatatccttgtacttacctgtcacaaatacggttcatccccgcaggtgcggggaacacccagatatgaccatgtatttgtggcttaaactcggttcatccccgcaggtgcggggaacacggtgtttcgtcctttccacaagat

SEQ ID NO: 1569 - DNA, 200 bp, Artificial Sequence
  Synthetic: Hsa398_Pseud
cccagctggttctttccgaaaaaaacggttcatccccgcaggtgcggggaacacaatgcccactgacctggtggtgggtagctgctcggttcatccccgcaggtgcggggaacacagaatctctgcccatgagaactctgaggcctccggttcatccccgcaggtgcggggaacacggtgtttcgtcctttccacaagat

SEQ ID NO: 1570 - DNA, 200 bp, Artificial Sequence
  Synthetic: Hsa399_Pseud
cccagctggttctttccgaaaaaaacggttcatccccgcaggtgcggggaacactccttctccctgtatctgaggatcatatactacggttcatccccgcaggtgcggggaacactgatcctgtaatctttttctttccagtaatcccggttcatccccgcaggtgcggggaacacggtgtttcgtcctttccacaagat

SEQ ID NO: 1571 - DNA, 200 bp, Artificial Sequence
  Synthetic: Hsa400_Pseud
cccagctggttctttccgaaaaaaacggttcatccccgcaggtgcggggaacaccgaacaacacaaatggataacggcccgcttaccggttcatccccgcaggtgcggggaacacagtacagggcccgcgcatgcgtggattgtcgtcggttcatccccgcaggtgcggggaacacggtgtttcgtcctttccacaagat

SEQ ID NO: 1572 - DNA, 200 bp, Artificial Sequence
  Synthetic: Hsa401_Pseud
cccagctggttctttccgaaaaaaacggttcatccccgcaggtgcggggaacacatgtaaaagacttttttttatacgataaataacggttcatccccgcaggtgcggggaacaccaagcaataaaaactgtacaatattggtcagtcggttcatccccgcaggtgcggggaacacggtgtttcgtcctttccacaagat

SEQ ID NO: 1573 - DNA, 200 bp, Artificial Sequence
  Synthetic: Hsa402_Pseud
cccagctggttctttccgaaaaaaacggttcatccccgcaggtgcggggaacacagcttgggcagccacctccttaggtgttagtgcggttcatccccgcaggtgcggggaacacacagcggtaaatacagaacagaaaataaccatcggttcatccccgcaggtgcggggaacacggtgtttcgtcctttccacaagat

SEQ ID NO: 1574 - DNA, 200 bp, Artificial Sequence
  Synthetic: Hsa403_Pseud
cccagctggttctttccgaaaaaaacggttcatccccgcaggtgcggggaacacggcggtgggggaagacttaaccgagttgccgtcggttcatccccgcaggtgcggggaacacgggagatgtagtcccgggccgacgcattacctcggttcatccccgcaggtgcggggaacacggtgtttcgtcctttccacaagat

SEQ ID NO: 1575 - DNA, 200 bp, Artificial Sequence
  Synthetic: Hsa404_Pseud
cccagctggttctttccgaaaaaaacggttcatccccgcaggtgcggggaacactggcatgaggagggggaagcttttttgaatcgcggttcatccccgcaggtgcggggaacactttattaatgaattgatttccataaagcaaatcggttcatccccgcaggtgcggggaacacggtgtttcgtcctttccacaagat

SEQ ID NO: 1576 - DNA, 200 bp, Artificial Sequence
  Synthetic: Hsa405_Pseud
cccagctggttctttccgaaaaaaacggttcatccccgcaggtgcggggaacacgtagagcagcatccagaaagtctgttattcctcggttcatccccgcaggtgcggggaacacgtcaaacactgataccccaaaataggattttccggttcatccccgcaggtgcggggaacacggtgtttcgtcctttccacaagat

SEQ ID NO: 1577 - DNA, 200 bp, Artificial Sequence
  Synthetic: Hsa406_Pseud
cccagctggttctttccgaaaaaaacggttcatccccgcaggtgcggggaacacccgcttcccctctcaggccagcttccctaaggcggttcatccccgcaggtgcggggaacacgactctagggtccagtggatgccacagcccagcggttcatccccgcaggtgcggggaacacggtgtttcgtcctttccacaagat

SEQ ID NO: 1578 - DNA, 200 bp, Artificial Sequence; identical to SEQ ID NO: 1577
  Synthetic: Hsa407_Pseud

SEQ ID NO: 1579 - DNA, 200 bp, Artificial Sequence
  Synthetic: Hsa408_Pseud
cccagctggttctttccgaaaaaaacggttcatccccgcaggtgcggggaacacacaaaacataccctatcaatggcactgcccttcggttcatccccgcaggtgcggggaacacttgtgtcctggctaaatcagaactcgaatggccggttcatccccgcaggtgcggggaacacggtgtttcgtcctttccacaagat

SEQ ID NO: 1580 - DNA, 200 bp, Artificial Sequence
  Synthetic: Hsa409_Pseud
cccagctggttctttccgaaaaaaacggttcatccccgcaggtgcggggaacacggccaccctggatgggagccgtgttcattacccggttcatccccgcaggtgcggggaacactggggctggatatgggtgagaacctggagccgcggttcatccccgcaggtgcggggaacacggtgtttcgtcctttccacaagat

SEQ ID NO: 1581 - DNA, 200 bp, Artificial Sequence
  Synthetic: Hsa410_Pseud
cccagctggttctttccgaaaaaaacggttcatccccgcaggtgcggggaacactggacattcatctgtttccactgagtctgagtcggttcatccccgcaggtgcggggaacacaaaaaaaagttatttatcgtataaaaaaaagtcggttcatccccgcaggtgcggggaacacggtgtttcgtcctttccacaagat

SEQ ID NO: 1582 - DNA, 200 bp, Artificial Sequence
  Synthetic: Hsa411_Pseud
cccagctggttctttccgaaaaaaacggttcatccccgcaggtgcggggaacacttttttttttcctcctaaggaaggttttttttcggttcatccccgcaggtgcggggaacacgcactgagacgctgagggtttcaaagtcacatcggttcatccccgcaggtgcggggaacacggtgtttcgtcctttccacaagat

SEQ ID NO: 1583 - DNA, 200 bp, Artificial Sequence
  Synthetic: Hsa412_Pseud
cccagctggttctttccgaaaaaaacggttcatccccgcaggtgcggggaacacagagcacagaagttttctgctgtctttggaatcggttcatccccgcaggtgcggggaacacgtgttcttagaaattgccatcgacagtgagcccggttcatccccgcaggtgcggggaacacggtgtttcgtcctttccacaagat

SEQ ID NO: 1584 - DNA, 200 bp, Artificial Sequence
  Synthetic: Hsa413_Pseud
cccagctggttctttccgaaaaaaacggttcatccccgcaggtgcggggaacacataataagtattctctgttttcaggtgtgtagcggttcatccccgcaggtgcggggaacactggaactttccttccagagatgtggctactaacggttcatccccgcaggtgcggggaacacggtgtttcgtcctttccacaagat

SEQ ID NO: 1585 - DNA, 200 bp, Artificial Sequence
  Synthetic: Hsa414_Pseud
cccagctggttctttccgaaaaaaacggttcatccccgcaggtgcggggaacacgccgtagctgaaattggctgcaccatgtcggccggttcatccccgcaggtgcggggaacaccacttacagtcaaacaccgtgtagttgaagcccggttcatccccgcaggtgcggggaacacggtgtttcgtcctttccacaagat

SEQ ID NO: 1586 - DNA, 200 bp, Artificial Sequence
  Synthetic: Hsa415_Pseud
cccagctggttctttccgaaaaaaacggttcatccccgcaggtgcggggaacacgagcattgcaatttcaacgacgtcacaacccgcggttcatccccgcaggtgcggggaacactcaagctgttcgttaaagttacacaggtccttcggttcatccccgcaggtgcggggaacacggtgtttcgtcctttccacaagat

SEQ ID NO: 1587 - DNA, 200 bp, Artificial Sequence
  Synthetic: Hsa416_Pseud
cccagctggttctttccgaaaaaaacggttcatccccgcaggtgcggggaacactttccacattccacattctcattaacatttagcggttcatccccgcaggtgcggggaacacgatgaaaaatatgcaaacatcactgtggattacggttcatccccgcaggtgcggggaacacggtgtttcgtcctttccacaagat

SEQ ID NO: 1588 - DNA, 200 bp, Artificial Sequence
  Synthetic: Hsa417_Pseud
cccagctggttctttccgaaaaaaacggttcatccccgcaggtgcggggaacacctattccatttacctcagagtatgttctgctgcggttcatccccgcaggtgcggggaacacaaggtggaactagccaatatgaatagacttttcggttcatccccgcaggtgcggggaacacggtgtttcgtcctttccacaagat

SEQ ID NO: 1589 - DNA, 200 bp, Artificial Sequence
  Synthetic: Hsa418_Pseud
cccagctggttctttccgaaaaaaacggttcatccccgcaggtgcggggaacacctagggatcatgaaataataaactgaaaaaaacggttcatccccgcaggtgcggggaacacccatttaatcccatgggcctctgctccctcaacggttcatccccgcaggtgcggggaacacggtgtttcgtcctttccacaagat

SEQ ID NO: 1590 - DNA, 200 bp, Artificial Sequence
  Synthetic: Hsa419_Pseud
cccagctggttctttccgaaaaaaacggttcatccccgcaggtgcggggaacacccagttgagcaggtactgggagccaatattgtcggttcatccccgcaggtgcggggaacactccaccgtgcagctcatcacgcagctcatgcccggttcatccccgcaggtgcggggaacacggtgtttcgtcctttccacaagat

SEQ ID NO: 1591 - DNA, 200 bp, Artificial Sequence
  Synthetic: Hsa420_Pseud
cccagctggttctttccgaaaaaaacggttcatccccgcaggtgcggggaacacggggacagctctggaaaggggacgctcactcccggttcatccccgcaggtgcggggaacacgctggagggtggcagtgggaccgctccggcggcggttcatccccgcaggtgcggggaacacggtgtttcgtcctttccacaagat

SEQ ID NO: 1592 - DNA, 200 bp, Artificial Sequence; identical to SEQ ID NO: 1591
  Synthetic: Hsa421_Pseud

SEQ ID NO: 1593 - DNA, 200 bp, Artificial Sequence
  Synthetic: Hsa422_Pseud
cccagctggttctttccgaaaaaaacggttcatccccgcaggtgcggggaacacaaatggtattaagctcatcatggaatttctgccggttcatccccgcaggtgcggggaacactattttagctgctgtttgaggtttattttgttcggttcatccccgcaggtgcggggaacacggtgtttcgtcctttccacaagat

SEQ ID NO: 1594 - DNA, 200 bp, Artificial Sequence
  Synthetic: Hsa423_Pseud
cccagctggttctttccgaaaaaaacggttcatccccgcaggtgcggggaacactaacagcacatgcatctttccctccagggccacggttcatccccgcaggtgcggggaacactttaacagccacctgctcccctgtattgtccccggttcatccccgcaggtgcggggaacacggtgtttcgtcctttccacaagat

SEQ ID NO: 1595 - DNA, 200 bp, Artificial Sequence
  Synthetic: Hsa424_Pseud
cccagctggttctttccgaaaaaaacggttcatccccgcaggtgcggggaacactgcatgaactatgaccccaatcagaggcctttcggttcatccccgcaggtgcggggaacacttaaagcagcacatggcaggtcttactctgctcggttcatccccgcaggtgcggggaacacggtgtttcgtcctttccacaagat

SEQ ID NO: 1596 - DNA, 200 bp, Artificial Sequence
  Synthetic: Hsa425_Pseud
cccagctggttctttccgaaaaaaacggttcatccccgcaggtgcggggaacacatgtgtgtctaggcaggacctgtggccaagttcggttcatccccgcaggtgcggggaacacgattcactacacgctctggaatgttcagttcccggttcatccccgcaggtgcggggaacacggtgtttcgtcctttccacaagat

SEQ ID NO: 1597 - DNA, 200 bp, Artificial Sequence
  Synthetic: Hsa426_Pseud
cccagctggttctttccgaaaaaaacggttcatccccgcaggtgcggggaacacaccaggagcccagtggggagggtgctttgttccggttcatccccgcaggtgcggggaacacggcctagggtgtggaggagccttgccatcgggcggttcatccccgcaggtgcggggaacacggtgtttcgtcctttccacaagat

SEQ ID NO: 1598 - DNA, 200 bp, Artificial Sequence
  Synthetic: Hsa427_Pseud
cccagctggttctttccgaaaaaaacggttcatccccgcaggtgcggggaacacttgccatgattttttcagtaaagggcatcttccggttcatccccgcaggtgcggggaacacaaatcaaagaaaatttatctcctttcttcaggcggttcatccccgcaggtgcggggaacacggtgtttcgtcctttccacaagat

SEQ ID NO: 1599 - DNA, 200 bp, Artificial Sequence
  Synthetic: Hsa428_Pseud
cccagctggttctttccgaaaaaaacggttcatccccgcaggtgcggggaacacggtttcctttagaaataaagagatctcagcagcggttcatccccgcaggtgcggggaacacgtcttccttcaccttccacaaagcaactctttcggttcatccccgcaggtgcggggaacacggtgtttcgtcctttccacaagat

SEQ ID NO: 1600 - DNA, 200 bp, Artificial Sequence
  Synthetic: Hsa429_Pseud
cccagctggttctttccgaaaaaaacggttcatccccgcaggtgcggggaacacagatcagcaacaatgagggagcagctgcaccacggttcatccccgcaggtgcggggaacactccatctatttgtctggtttttgcagccactacggttcatccccgcaggtgcggggaacacggtgtttcgtcctttccacaagat

SEQ ID NO: 1601 - DNA, 200 bp, Artificial Sequence
  Synthetic: Hsa430_Pseud
cccagctggttctttccgaaaaaaacggttcatccccgcaggtgcggggaacacccatctgggaactcaagcaggaaggaaggttccggttcatccccgcaggtgcggggaacactggcatcaagaggtgggagggccctccgaccacggttcatccccgcaggtgcggggaacacggtgtttcgtcctttccacaagat

SEQ ID NO: 1602 - DNA, 200 bp, Artificial Sequence; identical to SEQ ID NO: 1601
  Synthetic: Hsa431_Pseud

SEQ ID NO: 1603 - DNA, 200 bp, Artificial Sequence
  Synthetic: Hsa432_Pseud
cccagctggttctttccgaaaaaaacggttcatccccgcaggtgcggggaacacaaaacaaaacataccctatcaatggcactgcccggttcatccccgcaggtgcggggaacacttgtgtcctggctaaatcagaactcgaatggccggttcatccccgcaggtgcggggaacacggtgtttcgtcctttccacaagat

SEQ ID NO: 1604 - DNA, 200 bp, Artificial Sequence
  Synthetic: Hsa433_Pseud
cccagctggttctttccgaaaaaaacggttcatccccgcaggtgcggggaacactacttttagaaaaataacagtggagagcacagcggttcatccccgcaggtgcggggaacactcctttcccctgtgtgggataatctctcccagcggttcatccccgcaggtgcggggaacacggtgtttcgtcctttccacaagat

SEQ ID NO: 1605 - DNA, 200 bp, Artificial Sequence
  Synthetic: Hsa434_Pseud
cccagctggttctttccgaaaaaaacggttcatccccgcaggtgcggggaacactttctcccaggaagctttgatttttaccgtttcggttcatccccgcaggtgcggggaacactatcattacaagagagcaggtgcaaaaggttacggttcatccccgcaggtgcggggaacacggtgtttcgtcctttccacaagat

SEQ ID NO: 1606 - DNA, 200 bp, Artificial Sequence
  Synthetic: Hsa435_Pseud
cccagctggttctttccgaaaaaaacggttcatccccgcaggtgcggggaacacgctctgtcgttcgtggcgctcgtggacggctacggttcatccccgcaggtgcggggaacacacttcctccagcagcctcggcggtgccacctccggttcatccccgcaggtgcggggaacacggtgtttcgtcctttccacaagat

SEQ ID NO: 1607 - DNA, 200 bp, Artificial Sequence
  Synthetic: Hsa436_Pseud
cccagctggttctttccgaaaaaaacggttcatccccgcaggtgcggggaacacggtactccccctccttcccaggtcctccagcccggttcatccccgcaggtgcggggaacactgctctccggccgggccaacgcgcggggcctgcggttcatccccgcaggtgcggggaacacggtgtttcgtcctttccacaagat

SEQ ID NO: 1608 - DNA, 200 bp, Artificial Sequence
  Synthetic: Hsa437_Pseud
cccagctggttctttccgaaaaaaacggttcatccccgcaggtgcggggaacacgagcattgcaatttcaacgacgtcacaacccgcggttcatccccgcaggtgcggggaacacttttcaagctgttcgttaaagttacacaggtccggttcatccccgcaggtgcggggaacacggtgtttcgtcctttccacaagat

SEQ ID NO: 1609 - DNA, 200 bp, Artificial Sequence
  Synthetic: Hsa438_Pseud
cccagctggttctttccgaaaaaaacggttcatccccgcaggtgcggggaacacagtgctcgcttcctggtctccttggcgcgaaccggttcatccccgcaggtgcggggaacacagcatagcagaggatgaggacctcagggttcacggttcatccccgcaggtgcggggaacacggtgtttcgtcctttccacaagat

SEQ ID NO: 1610 - DNA, 200 bp, Artificial Sequence
  Synthetic: Hsa439_Pseud
cccagctggttctttccgaaaaaaacggttcatccccgcaggtgcggggaacactttcaacaatgttctctagtttcaagctccagcggttcatccccgcaggtgcggggaacacgtagttcagttattattgagtctcactttctacggttcatccccgcaggtgcggggaacacggtgtttcgtcctttccacaagat

SEQ ID NO: 1611 - DNA, 200 bp, Artificial Sequence
  Synthetic: Hsa440_Pseud
cccagctggttctttccgaaaaaaacggttcatccccgcaggtgcggggaacacacacacccccaaccccaggcagcctctagagccggttcatccccgcaggtgcggggaacacggtttcaggcacttcagtaagagactttcccccggttcatccccgcaggtgcggggaacacggtgtttcgtcctttccacaagat

SEQ ID NO: 1612 - DNA, 52 bp, Artificial Sequence
  Synthetic: Hsa345_ilmn_F
cactctttccctacacgacgctcttccgatcttagcatctctacgggccatt

SEQ ID NO: 1613 - DNA, 52 bp, Artificial Sequence
  Synthetic: Hsa346_ilmn_F
cactctttccctacacgacgctcttccgatctctcgttggaagaggaacagc

SEQ ID NO: 1614 - DNA, 52 bp, Artificial Sequence; identical to SEQ ID NO: 1613
  Synthetic: Hsa347_ilmn_F

SEQ ID NO: 1615 - DNA, 52 bp, Artificial Sequence
  Synthetic: Hsa348_ilmn_F
cactctttccctacacgacgctcttccgatctagaggagctgaagacccaca

SEQ ID NO: 1616 - DNA, 52 bp, Artificial Sequence
  Synthetic: Hsa349_ilmn_F
cactctttccctacacgacgctcttccgatctcacagggtgatgattgatgg

SEQ ID NO: 1617 - DNA, 56 bp, Artificial Sequence
  Synthetic: Hsa350_ilmn_F
cactctttccctacacgacgctcttccgatctgagaaggacttgataatctgtgga

SEQ ID NO: 1618 - DNA, 55 bp, Artificial Sequence
  Synthetic: Hsa351_ilmn_F
cactctttccctacacgacgctcttccgatctccgacagatagaagatcacttcc

SEQ ID NO: 1619 - DNA, 50 bp, Artificial Sequence
  Synthetic: Hsa352_ilmn_F
cactctttccctacacgacgctcttccgatctctgcatggccgacaagat

SEQ ID NO: 1620 - DNA, 56 bp, Artificial Sequence
  Synthetic: Hsa353_ilmn_F
cactctttccctacacgacgctcttccgatctttggatggaatactatttggaaca

SEQ ID NO: 1621 - DNA, 52 bp, Artificial Sequence
  Synthetic: Hsa354_ilmn_F
cactctttccctacacgacgctcttccgatctaccctgttcagtgctctgct

SEQ ID NO: 1622 - DNA, 54 bp, Artificial Sequence
  Synthetic: Hsa355_ilmn_F
cactctttccctacacgacgctcttccgatcttgcccatgactattctagcaac

SEQ ID NO: 1623 - DNA, 52 bp, Artificial Sequence
  Synthetic: Hsa356_ilmn_F
cactctttccctacacgacgctcttccgatctaacattgttgaaaggctggc

SEQ ID NO: 1624 - DNA, 52 bp, Artificial Sequence
  Synthetic: Hsa357_ilmn_F
cactctttccctacacgacgctcttccgatcttcaatcaaaggtggtctgga

SEQ ID NO: 1625 - DNA, 52 bp, Artificial Sequence; identical to SEQ ID NO: 1621
  Synthetic: Hsa358_ilmn_F

SEQ ID NO: 1626 - DNA, 52 bp, Artificial Sequence
  Synthetic: Hsa359_ilmn_F
cactctttccctacacgacgctcttccgatctgagagagagagaggcaggca

SEQ ID NO: 1627 - DNA, 52 bp, Artificial Sequence
  Synthetic: Hsa360_ilmn_F
cactctttccctacacgacgctcttccgatcttcactgcaccatagagacgc

SEQ ID NO: 1628 - DNA, 52 bp, Artificial Sequence
  Synthetic: Hsa361_ilmn_F
cactctttccctacacgacgctcttccgatctttggaggagagatgagggaa

SEQ ID NO: 1629 - DNA, 51 bp, Artificial Sequence
  Synthetic: Hsa362_ilmn_F
cactctttccctacacgacgctcttccgatcttcctgtgtgagtgctgcaa

SEQ ID NO: 1630 - DNA, 52 bp, Artificial Sequence
  Synthetic: Hsa363_ilmn_F
cactctttccctacacgacgctcttccgatctggaatcctgcacccactaaa

SEQ ID NO: 1631 - DNA, 59 bp, Artificial Sequence
  Synthetic: Hsa364_ilmn_F
cactctttccctacacgacgctcttccgatctgagagatgcaccttatttctctagtgt

SEQ ID NO: 1632 - DNA, 57 bp, Artificial Sequence
  Synthetic: Hsa365_ilmn_F
cactctttccctacacgacgctcttccgatctaaatttccaatagtttggagactca

SEQ ID NO: 1633 - DNA, 52 bp, Artificial Sequence
  Synthetic: Hsa366_ilmn_F
cactctttccctacacgacgctcttccgatctccagcaccacaggacataaa

SEQ ID NO: 1634 - DNA, 52 bp, Artificial Sequence
  Synthetic: Hsa367_ilmn_F
cactctttccctacacgacgctcttccgatctgactcaccaggccactcttc

SEQ ID NO: 1635 - DNA, 52 bp, Artificial Sequence
  Synthetic: Hsa368_ilmn_F
cactctttccctacacgacgctcttccgatctttgttcctccacctcattcc

SEQ ID NO: 1636 - DNA, 60 bp, Artificial Sequence
  Synthetic: Hsa369_ilmn_F
cactctttccctacacgacgctcttccgatctttcatcagaataccactattttcatttt

SEQ ID NO: 1637 - DNA, 60 bp, Artificial Sequence
  Synthetic: Hsa370_ilmn_F
cactctttccctacacgacgctcttccgatctttttcattttagttgctactctttgatt

SEQ ID NO: 1638 - DNA, 53 bp, Artificial Sequence
  Synthetic: Hsa371_ilmn_F
cactctttccctacacgacgctcttccgatcttgttgccttggtgagtcttct

SEQ ID NO: 1639 - DNA, 55 bp, Artificial Sequence
  Synthetic: Hsa372_ilmn_F
cactctttccctacacgacgctcttccgatctttatggagcttccatttagtggt

SEQ ID NO: 1640 - DNA, 56 bp, Artificial Sequence
  Synthetic: Hsa373_ilmn_F
cactctttccctacacgacgctcttccgatctaacagaagtgacagctttgagaac

SEQ ID NO: 1641 - DNA, 52 bp, Artificial Sequence
  Synthetic: Hsa374_ilmn_F
cactctttccctacacgacgctcttccgatctgccttgtcctcagccagtta

SEQ ID NO: 1642 - DNA, 52 bp, Artificial Sequence
  Synthetic: Hsa375_ilmn_F
cactctttccctacacgacgctcttccgatctatttaatcccatgggcctct

SEQ ID NO: 1643 - DNA, 52 bp, Artificial Sequence
  Synthetic: Hsa376_ilmn_F
cactctttccctacacgacgctcttccgatctccacaggagcacatcaagac

SEQ ID NO: 1644 - DNA, 52 bp, Artificial Sequence
  Synthetic: Hsa377_ilmn_F
cactctttccctacacgacgctcttccgatctgttcctgtattgcggcagag

SEQ ID NO: 1645 - DNA, 52 bp, Artificial Sequence
  Synthetic: Hsa378_ilmn_F
cactctttccctacacgacgctcttccgatctaagcaggtaccaagacacgc

SEQ ID NO: 1646 - DNA, 52 bp, Artificial Sequence
  Synthetic: Hsa379_ilmn_F
cactctttccctacacgacgctcttccgatctcaactccttgcttgggaagt

SEQ ID NO: 1647 - DNA, 52 bp, Artificial Sequence
  Synthetic: Hsa380_ilmn_F
cactctttccctacacgacgctcttccgatctaagggaatgcctccttccta

SEQ ID NO: 1648 - DNA, 58 bp, Artificial Sequence
  Synthetic: Hsa381_ilmn_F
cactctttccctacacgacgctcttccgatctctcctctttgaaacgattagtaatga

SEQ ID NO: 1649 - DNA, 57 bp, Artificial Sequence
  Synthetic: Hsa382_ilmn_F
cactctttccctacacgacgctcttccgatcttgatttcagaaagtctcaactacca

SEQ ID NO: 1650 - DNA, 52 bp, Artificial Sequence; identical to SEQ ID NO: 1621
  Synthetic: Hsa383_ilmn_F

SEQ ID NO: 1651 - DNA, 52 bp, Artificial Sequence; identical to SEQ ID NO: 1623
  Synthetic: Hsa384_ilmn_F

SEQ ID NO: 1652 - DNA, 52 bp, Artificial Sequence
  Synthetic: Hsa385_ilmn_F
cactctttccctacacgacgctcttccgatctggactggcaggtcaaggata

SEQ ID NO: 1653 - DNA, 52 bp, Artificial Sequence
  Synthetic: Hsa386_ilmn_F
cactctttccctacacgacgctcttccgatctggcaactattccagcttcca

SEQ ID NO: 1654 - DNA, 53 bp, Artificial Sequence
  Synthetic: Hsa387_ilmn_F
cactctttccctacacgacgctcttccgatctggtcctgcctagacacacatc

SEQ ID NO: 1655 - DNA, 52 bp, Artificial Sequence
  Synthetic: Hsa388_ilmn_F
cactctttccctacacgacgctcttccgatctcacttccaattcagcaagca

SEQ ID NO: 1656 - DNA, 52 bp, Artificial Sequence
  Synthetic: Hsa389_ilmn_F
cactctttccctacacgacgctcttccgatctgttgactttgagcaggaggc

SEQ ID NO: 1657 - DNA, 53 bp, Artificial Sequence
  Synthetic: Hsa390_ilmn_F
cactctttccctacacgacgctcttccgatctcacctgggtagtccttgatga

SEQ ID NO: 1658 - DNA, 59 bp, Artificial Sequence; identical to SEQ ID NO: 1631
  Synthetic: Hsa391_ilmn_F

SEQ ID NO: 1659 - DNA, 52 bp, Artificial Sequence
  Synthetic: Hsa392_ilmn_F
cactctttccctacacgacgctcttccgatctgtttccaagacatgatgggc

SEQ ID NO: 1660 - DNA, 53 bp, Artificial Sequence
  Synthetic: Hsa393_ilmn_F
cactctttccctacacgacgctcttccgatcttttcatcatagggctttgcac

SEQ ID NO: 1661 - DNA, 52 bp, Artificial Sequence
  Synthetic: Hsa394_ilmn_F
cactctttccctacacgacgctcttccgatctaagccatggagatcagagga

SEQ ID NO: 1662 - DNA, 52 bp, Artificial Sequence
  Synthetic: Hsa395_ilmn_F
cactctttccctacacgacgctcttccgatctttcccttgactttggcattt

SEQ ID NO: 1663 - DNA, 52 bp, Artificial Sequence; identical to SEQ ID NO: 1662
  Synthetic: Hsa396_ilmn_F

SEQ ID NO: 1664 - DNA, 52 bp, Artificial Sequence
  Synthetic: Hsa397_ilmn_F
cactctttccctacacgacgctcttccgatcttcttagggacacggctgact

SEQ ID NO: 1665 - DNA, 52 bp, Artificial Sequence
  Synthetic: Hsa398_ilmn_F
cactctttccctacacgacgctcttccgatctagatgtctgtggagagccgt

SEQ ID NO: 1666 - DNA, 52 bp, Artificial Sequence
  Synthetic: Hsa399_ilmn_F
cactctttccctacacgacgctcttccgatctaaatgttttggccttttgga

SEQ ID NO: 1667 - DNA, 52 bp, Artificial Sequence
  Synthetic: Hsa400_ilmn_F
cactctttccctacacgacgctcttccgatctcatgcgtgatgacgtagagg

SEQ ID NO: 1668 - DNA, 53 bp, Artificial Sequence; identical to SEQ ID NO: 1654
  Synthetic: Hsa401_ilmn_F

SEQ ID NO: 1669 - DNA, 52 bp, Artificial Sequence
  Synthetic: Hsa402_ilmn_F
cactctttccctacacgacgctcttccgatcttttaccacacaaagtgggca

SEQ ID NO: 1670 - DNA, 52 bp, Artificial Sequence; identical to SEQ ID NO: 1135
  Synthetic: Hsa403_ilmn_F

SEQ ID NO: 1671 - DNA, 54 bp, Artificial Sequence; identical to SEQ ID NO: 1622
  Synthetic: Hsa404_ilmn_F

SEQ ID NO: 1672 - DNA, 52 bp, Artificial Sequence; identical to SEQ ID NO: 1642
  Synthetic: Hsa405_ilmn_F

SEQ ID NO: 1673 - DNA, 52 bp, Artificial Sequence; identical to SEQ ID NO: 1613
  Synthetic: Hsa406_ilmn_F

SEQ ID NO: 1674 - DNA, 52 bp, Artificial Sequence; identical to SEQ ID NO: 1613
  Synthetic: Hsa407_ilmn_F

SEQ ID NO: 1675 - DNA, 52 bp, Artificial Sequence
  Synthetic: Hsa408_ilmn_F
cactctttccctacacgacgctcttccgatctcccatcaagccaactctcat

SEQ ID NO: 1676 - DNA, 52 bp, Artificial Sequence
  Synthetic: Hsa409_ilmn_F
cactctttccctacacgacgctcttccgatctcaaccaatgaaaccaaggct

SEQ ID NO: 1677 - DNA, 54 bp, Artificial Sequence
  Synthetic: Hsa410_ilmn_F
cactctttccctacacgacgctcttccgatctcaagacaaaaatccaacaagca

SEQ ID NO: 1678 - DNA, 54 bp, Artificial Sequence
  Synthetic: Hsa411_ilmn_F
cactctttccctacacgacgctcttccgatctggctaagggcacaagagaatta

SEQ ID NO: 1679 - DNA, 52 bp, Artificial Sequence
  Synthetic: Hsa412_ilmn_F
cactctttccctacacgacgctcttccgatctagccctgtactaccagcgtg

SEQ ID NO: 1680 - DNA, 52 bp, Artificial Sequence
  Synthetic: Hsa413_ilmn_F
cactctttccctacacgacgctcttccgatctaaacctttggttggatgctg

SEQ ID NO: 1681 - DNA, 52 bp, Artificial Sequence
  Synthetic: Hsa414_ilmn_F
cactctttccctacacgacgctcttccgatctagttgcccatggtcacaaat

SEQ ID NO: 1682 - DNA, 52 bp, Artificial Sequence
  Synthetic: Hsa415_ilmn_F
cactctttccctacacgacgctcttccgatctctgctgccagaaatggagtc

SEQ ID NO: 1683 - DNA, 60 bp, Artificial Sequence
  Synthetic: Hsa416_ilmn_F
cactctttccctacacgacgctcttccgatctgggatatttggttagttgatttgatatt

SEQ ID NO: 1684 - DNA, 60 bp, Artificial Sequence; identical to SEQ ID NO: 1637
  Synthetic: Hsa417_ilmn_F

SEQ ID NO: 1685 - DNA, 52 bp, Artificial Sequence
  Synthetic: Hsa418_ilmn_F
cactctttccctacacgacgctcttccgatctttcttgtcaggccctacacc

SEQ ID NO: 1686 - DNA, 52 bp, Artificial Sequence
  Synthetic: Hsa419_ilmn_F
cactctttccctacacgacgctcttccgatctctccaggaagcctacgtgat

SEQ ID NO: 1687 - DNA, 51 bp, Artificial Sequence
  Synthetic: Hsa420_ilmn_F
cactctttccctacacgacgctcttccgatctcccagagcctcagagaagg

SEQ ID NO: 1688 - DNA, 51 bp, Artificial Sequence; identical to SEQ ID NO: 1687
  Synthetic: Hsa421_ilmn_F

SEQ ID NO: 1689 - DNA, 52 bp, Artificial Sequence
  Synthetic: Hsa422_ilmn_F
cactctttccctacacgacgctcttccgatctttacccaggacagagtgcct

SEQ ID NO: 1690 - DNA, 52 bp, Artificial Sequence
  Synthetic: Hsa423_ilmn_F
cactctttccctacacgacgctcttccgatctacctccactctcaggcttca

SEQ ID NO: 1691 - DNA, 53 bp, Artificial Sequence
  Synthetic: Hsa424_ilmn_F
cactctttccctacacgacgctcttccgatctaaacagagtgaaaggcagtcg

SEQ ID NO: 1692 - DNA, 52 bp, Artificial Sequence
  Synthetic: Hsa425_ilmn_F
cactctttccctacacgacgctcttccgatctccacgggaatggagagatta

SEQ ID NO: 1693 - DNA, 52 bp, Artificial Sequence; identical to SEQ ID NO: 1662
  Synthetic: Hsa426_ilmn_F

SEQ ID NO: 1694 - DNA, 52 bp, Artificial Sequence; identical to SEQ ID NO: 1633
  Synthetic: Hsa427_ilmn_F

SEQ ID NO: 1695 - DNA, 52 bp, Artificial Sequence
  Synthetic: Hsa428_ilmn_F
cactctttccctacacgacgctcttccgatcttcatcctgagcactctgtgg

SEQ ID NO: 1696 - DNA, 52 bp, Artificial Sequence
  Synthetic: Hsa429_ilmn_F
cactctttccctacacgacgctcttccgatctgcctcaggctgtctgaactc

SEQ ID NO: 1697 - DNA, 52 bp, Artificial Sequence
  Synthetic: Hsa430_ilmn_F
cactctttccctacacgacgctcttccgatctcagaagccctgatgtgtcct

SEQ ID NO: 1698 - DNA, 52 bp, Artificial Sequence; identical to SEQ ID NO: 1697
  Synthetic: Hsa431_ilmn_F

SEQ ID NO: 1699 - DNA, 52 bp, Artificial Sequence; identical to SEQ ID NO: 1675
  Synthetic: Hsa432_ilmn_F

SEQ ID NO: 1700 - DNA, 53 bp, Artificial Sequence; identical to SEQ ID NO: 1660
  Synthetic: Hsa433_ilmn_F

SEQ ID NO: 1701 - DNA, 52 bp, Artificial Sequence
  Synthetic: Hsa434_ilmn_F
cactctttccctacacgacgctcttccgatctagaacaagggaggagctggt

SEQ ID NO: 1702 - DNA, 52 bp, Artificial Sequence
  Synthetic: Hsa435_ilmn_F
cactctttccctacacgacgctcttccgatctacaggtccttacgtgatggg

SEQ ID NO: 1703 - DNA, 52 bp, Artificial Sequence; identical to SEQ ID NO: 1630
  Synthetic: Hsa436_ilmn_F

SEQ ID NO: 1704 - DNA, 52 bp, Artificial Sequence; identical to SEQ ID NO: 1682
  Synthetic: Hsa437_ilmn_F

SEQ ID NO: 1705 - DNA, 52 bp, Artificial Sequence
  Synthetic: Hsa438_ilmn_F
cactctttccctacacgacgctcttccgatctccttgacttgatgcacctga

SEQ ID NO: 1706 - DNA, 53 bp, Artificial Sequence
  Synthetic: Hsa439_ilmn_F
cactctttccctacacgacgctcttccgatctaggagagtagaattgggctgg

SEQ ID NO: 1707 - DNA, 52 bp, Artificial Sequence; identical to SEQ ID NO: 1623
  Synthetic: Hsa440_ilmn_F

SEQ ID NO: 1708 - DNA, 48 bp, Artificial Sequence
  Synthetic: Hsa345_ilmn_R
ggagttcagacgtgtgctcttccgatcttaccagagagctcaggaggg

SEQ ID NO: 1709 - DNA, 48 bp, Artificial Sequence
  Synthetic: Hsa346_ilmn_R
ggagttcagacgtgtgctcttccgatctacagtctctgaatgggtcgc

SEQ ID NO: 1710 - DNA, 48 bp, Artificial Sequence; identical to SEQ ID NO: 1709
  Synthetic: Hsa347_ilmn_R

SEQ ID NO: 1711 - DNA, 48 bp, Artificial Sequence
  Synthetic: Hsa348_ilmn_R
ggagttcagacgtgtgctcttccgatcttaactggctgaggacaaggc

SEQ ID NO: 1712 - DNA, 48 bp, Artificial Sequence
  Synthetic: Hsa349_ilmn_R
ggagttcagacgtgtgctcttccgatctactcattcccagaacctgga

SEQ ID NO: 1713 - DNA, 50 bp, Artificial Sequence
  Synthetic: Hsa350_ilmn_R
ggagttcagacgtgtgctcttccgatctaaaagtcattgcatttccaaaa

SEQ ID NO: 1714 - DNA, 48 bp, Artificial Sequence
  Synthetic: Hsa351_ilmn_R
ggagttcagacgtgtgctcttccgatctccaacaccaaatgtttctgc

SEQ ID NO: 1715 - DNA, 50 bp, Artificial Sequence
  Synthetic: Hsa352_ilmn_R
ggagttcagacgtgtgctcttccgatcttgttcacctgtttcatctgagg

SEQ ID NO: 1716 - DNA, 48 bp, Artificial Sequence
  Synthetic: Hsa353_ilmn_R
ggagttcagacgtgtgctcttccgatctcagcaaccacacccatagtg

SEQ ID NO: 1717 - DNA, 48 bp, Artificial Sequence
  Synthetic: Hsa354_ilmn_R
ggagttcagacgtgtgctcttccgatctggttcagaagccctggaaat

SEQ ID NO: 1718 - DNA, 48 bp, Artificial Sequence
  Synthetic: Hsa355_ilmn_R
ggagttcagacgtgtgctcttccgatctagctggatccacatggtctt

SEQ ID NO: 1719 - DNA, 48 bp, Artificial Sequence
  Synthetic: Hsa356_ilmn_R
ggagttcagacgtgtgctcttccgatctaaggaatggtcctctgggag

SEQ ID NO: 1720 - DNA, 46 bp, Artificial Sequence
  Synthetic: Hsa357_ilmn_R
ggagttcagacgtgtgctcttccgatctccggaggtcccaaacagt

SEQ ID NO: 1721 - DNA, 48 bp, Artificial Sequence; identical to SEQ ID NO: 1717
  Synthetic: Hsa358_ilmn_R

SEQ ID NO: 1722 - DNA, 48 bp, Artificial Sequence
  Synthetic: Hsa359_ilmn_R
ggagttcagacgtgtgctcttccgatcttcagactcccagaattgggt

SEQ ID NO: 1723 - DNA, 48 bp, Artificial Sequence
  Synthetic: Hsa360_ilmn_R
ggagttcagacgtgtgctcttccgatctgtcagcatgatgtcagaggc

SEQ ID NO: 1724 - DNA, 47 bp, Artificial Sequence
  Synthetic: Hsa361_ilmn_R
ggagttcagacgtgtgctcttccgatctttgcagcactcacacagga

SEQ ID NO: 1725 - DNA, 48 bp, Artificial Sequence
  Synthetic: Hsa362_ilmn_R
ggagttcagacgtgtgctcttccgatctatctcttacgcccaaccctt

SEQ ID NO: 1726 - DNA, 48 bp, Artificial Sequence
  Synthetic: Hsa363_ilmn_R
ggagttcagacgtgtgctcttccgatctttgaatggcaaagggatagg

SEQ ID NO: 1727 - DNA, 56 bp, Artificial Sequence
  Synthetic: Hsa364_ilmn_R
ggagttcagacgtgtgctcttccgatctgtaaaggttgtaataccttccactaggt

SEQ ID NO: 1728 - DNA, 54 bp, Artificial Sequence
  Synthetic: Hsa365_ilmn_R
ggagttcagacgtgtgctcttccgatctaacatttggtagttgagactttctga

SEQ ID NO: 1729 - DNA, 48 bp, Artificial Sequence
  Synthetic: Hsa366_ilmn_R
ggagttcagacgtgtgctcttccgatctgatagccttcatcttgccca

SEQ ID NO: 1730 - DNA, 48 bp, Artificial Sequence
  Synthetic: Hsa367_ilmn_R
ggagttcagacgtgtgctcttccgatcttagcccacatgtccacattc

SEQ ID NO: 1731 - DNA, 48 bp, Artificial Sequence
  Synthetic: Hsa368_ilmn_R
ggagttcagacgtgtgctcttccgatctaactgctaatggcccgttct

SEQ ID NO: 1732 - DNA, 52 bp, Artificial Sequence
  Synthetic: Hsa369_ilmn_R
ggagttcagacgtgtgctcttccgatctatggtacttgattgctattccatt

SEQ ID NO: 1733 - DNA, 53 bp, Artificial Sequence
  Synthetic: Hsa370_ilmn_R
ggagttcagacgtgtgctcttccgatctttcactgaatatggtacttgattgc

SEQ ID NO: 1734 - DNA, 48 bp, Artificial Sequence
  Synthetic: Hsa371_ilmn_R
ggagttcagacgtgtgctcttccgatctgatgcaatgccaacttgaga

SEQ ID NO: 1735 - DNA, 55 bp, Artificial Sequence
  Synthetic: Hsa372_ilmn_R
ggagttcagacgtgtgctcttccgatctgctgatcttaaaatattactgacctgg

SEQ ID NO: 1736 - DNA, 48 bp, Artificial Sequence
  Synthetic: Hsa373_ilmn_R
ggagttcagacgtgtgctcttccgatctgagaggactgggaaatgcac

SEQ ID NO: 1737 - DNA, 48 bp, Artificial Sequence
  Synthetic: Hsa374_ilmn_R
ggagttcagacgtgtgctcttccgatcttggatgcaaggcatacacac

SEQ ID NO: 1738 - DNA, 47 bp, Artificial Sequence
  Synthetic: Hsa375_ilmn_R
ggagttcagacgtgtgctcttccgatctgcaacatccttcaattgcg

SEQ ID NO: 1739 - DNA, 48 bp, Artificial Sequence
  Synthetic: Hsa376_ilmn_R
ggagttcagacgtgtgctcttccgatctcatcctcccagcatgctcta

SEQ ID NO: 1740 - DNA, 48 bp, Artificial Sequence
  Synthetic: Hsa377_ilmn_R
ggagttcagacgtgtgctcttccgatctacctcagaggctgttcttgg

SEQ ID NO: 1741 - DNA, 51 bp, Artificial Sequence
  Synthetic: Hsa378_ilmn_R
ggagttcagacgtgtgctcttccgatctcttctttcgaatcccaaatacct

SEQ ID NO: 1742 - DNA, 48 bp, Artificial Sequence
  Synthetic: Hsa379_ilmn_R
ggagttcagacgtgtgctcttccgatctagggcagtacagcaggagaa

SEQ ID NO: 1743 - DNA, 48 bp, Artificial Sequence
  Synthetic: Hsa380_ilmn_R
ggagttcagacgtgtgctcttccgatctacctacctctcagccactgc

SEQ ID NO: 1744 - DNA, 54 bp, Artificial Sequence
  Synthetic: Hsa381_ilmn_R
ggagttcagacgtgtgctcttccgatctcttcatcaaatatgtcaccagaagtt

SEQ ID NO: 1745 - DNA, 50 bp, Artificial Sequence
  Synthetic: Hsa382_ilmn_R
ggagttcagacgtgtgctcttccgatcttgatagaagactcaccaaggca

SEQ ID NO: 1746 - DNA, 48 bp, Artificial Sequence; identical to SEQ ID NO: 1717
  Synthetic: Hsa383_ilmn_R

SEQ ID NO: 1747 - DNA, 48 bp, Artificial Sequence; identical to SEQ ID NO: 1719
  Synthetic: Hsa384_ilmn_R

SEQ ID NO: 1748 - DNA, 48 bp, Artificial Sequence
  Synthetic: Hsa385_ilmn_R
ggagttcagacgtgtgctcttccgatcttcactcctactgaggctggg

SEQ ID NO: 1749 - DNA, 48 bp, Artificial Sequence
  Synthetic: Hsa386_ilmn_R
ggagttcagacgtgtgctcttccgatctgttcatgcagcctcttgtcc

SEQ ID NO: 1750 - DNA, 51 bp, Artificial Sequence
  Synthetic: Hsa387_ilmn_R
ggagttcagacgtgtgctcttccgatctttccactgagtctgagtcttcaa

SEQ ID NO: 1751 - DNA, 48 bp, Artificial Sequence
  Synthetic: Hsa388_ilmn_R
ggagttcagacgtgtgctcttccgatctgaaaccctcagcgtctcagt

SEQ ID NO: 1752 - DNA, 48 bp, Artificial Sequence
  Synthetic: Hsa389_ilmn_R
ggagttcagacgtgtgctcttccgatctcacactgatgaagcgtgtcc

SEQ ID NO: 1753 - DNA, 48 bp, Artificial Sequence
  Synthetic: Hsa390_ilmn_R
ggagttcagacgtgtgctcttccgatctttgggaaagctggctacact

SEQ ID NO: 1754 - DNA, 56 bp, Artificial Sequence; identical to SEQ ID NO: 1727
  Synthetic: Hsa391_ilmn_R

SEQ ID NO: 1755 - DNA, 48 bp, Artificial Sequence
  Synthetic: Hsa392_ilmn_R
ggagttcagacgtgtgctcttccgatcttgccaatttaagagaacggg

SEQ ID NO: 1756 - DNA, 52 bp, Artificial Sequence
  Synthetic: Hsa393_ilmn_R
ggagttcagacgtgtgctcttccgatctagcagaagaggacagtaaacaatg

SEQ ID NO: 1757 - DNA, 48 bp, Artificial Sequence
  Synthetic: Hsa394_ilmn_R
ggagttcagacgtgtgctcttccgatctagaacaggcctcccaagttt

SEQ ID NO: 1758 - DNA, 48 bp, Artificial Sequence
  Synthetic: Hsa395_ilmn_R
ggagttcagacgtgtgctcttccgatctgtgaggacttggagctctgc

SEQ ID NO: 1759 - DNA, 48 bp, Artificial Sequence
  Synthetic: Hsa396_ilmn_R
ggagttcagacgtgtgctcttccgatctcaggcgtatctgtgtgagga

SEQ ID NO: 1760 - DNA, 48 bp, Artificial Sequence
  Synthetic: Hsa397_ilmn_R
ggagttcagacgtgtgctcttccgatctagcaggcttctcacttccag

SEQ ID NO: 1761 - DNA, 48 bp, Artificial Sequence
  Synthetic: Hsa398_ilmn_R
ggagttcagacgtgtgctcttccgatctattctgggagaccagcacac

SEQ ID NO: 1762 - DNA, 48 bp, Artificial Sequence
  Synthetic: Hsa399_ilmn_R
ggagttcagacgtgtgctcttccgatcttgcttgccagctctaatcaa

SEQ ID NO: 1763 - DNA, 48 bp, Artificial Sequence
  Synthetic: Hsa400_ilmn_R
ggagttcagacgtgtgctcttccgatcttcgcacacttaaggctaacg

SEQ ID NO: 1764 - DNA, 51 bp, Artificial Sequence; identical to SEQ ID NO: 1750
  Synthetic: Hsa401_ilmn_R

SEQ ID NO: 1765 - DNA, 48 bp, Artificial Sequence
  Synthetic: Hsa402_ilmn_R
ggagttcagacgtgtgctcttccgatctgaagtcggcctctctctcct

SEQ ID NO: 1766 - DNA, 48 bp, Artificial Sequence; identical to SEQ ID NO: 1192
  Synthetic: Hsa403_ilmn_R

SEQ ID NO: 1767 - DNA, 48 bp, Artificial Sequence
  Synthetic: Hsa404_ilmn_R
ggagttcagacgtgtgctcttccgatctgatccacatggtcttgaggg

SEQ ID NO: 1768 - DNA, 47 bp, Artificial Sequence; identical to SEQ ID NO: 1738
  Synthetic: Hsa405_ilmn_R

SEQ ID NO: 1769 - DNA, 48 bp, Artificial Sequence; identical to SEQ ID NO: 1709
  Synthetic: Hsa406_ilmn_R

SEQ ID NO: 1770 - DNA, 48 bp, Artificial Sequence; identical to SEQ ID NO: 1709
  Synthetic: Hsa407_ilmn_R

SEQ ID NO: 1771 - DNA, 48 bp, Artificial Sequence
  Synthetic: Hsa408_ilmn_R
ggagttcagacgtgtgctcttccgatctaccaaacacagcagggactc

SEQ ID NO: 1772 - DNA, 48 bp, Artificial Sequence
  Synthetic: Hsa409_ilmn_R
ggagttcagacgtgtgctcttccgatctacctctgttctgagccgcta

SEQ ID NO: 1773 - DNA, 48 bp, Artificial Sequence
  Synthetic: Hsa410_ilmn_R
ggagttcagacgtgtgctcttccgatctagagggtccagcctcaagat

SEQ ID NO: 1774 - DNA, 48 bp, Artificial Sequence
  Synthetic: Hsa411_ilmn_R
ggagttcagacgtgtgctcttccgatctggagtggcctctttgtgtgt

SEQ ID NO: 1775 - DNA, 48 bp, Artificial Sequence
  Synthetic: Hsa412_ilmn_R
ggagttcagacgtgtgctcttccgatctccaccctgacacataaaccc

SEQ ID NO: 1776 - DNA, 50 bp, Artificial Sequence
  Synthetic: Hsa413_ilmn_R
ggagttcagacgtgtgctcttccgatctaatgattgttggagtgctttca

SEQ ID NO: 1777 - DNA, 48 bp, Artificial Sequence
  Synthetic: Hsa414_ilmn_R
ggagttcagacgtgtgctcttccgatctgccaatgtttggagtctggt

SEQ ID NO: 1778 - DNA, 49 bp, Artificial Sequence
  Synthetic: Hsa415_ilmn_R
ggagttcagacgtgtgctcttccgatctttacccttgtgtgtgtctccc

SEQ ID NO: 1779 - DNA, 48 bp, Artificial Sequence
  Synthetic: Hsa416_ilmn_R
ggagttcagacgtgtgctcttccgatctatgcacctcattgtttgtgc

SEQ ID NO: 1780 - DNA, 53 bp, Artificial Sequence; identical to SEQ ID NO: 1733
  Synthetic: Hsa417_ilmn_R

SEQ ID NO: 1781 - DNA, 48 bp, Artificial Sequence
  Synthetic: Hsa418_ilmn_R
ggagttcagacgtgtgctcttccgatctcatggtagagcagcatccag

SEQ ID NO: 1782 - DNA, 48 bp, Artificial Sequence
  Synthetic: Hsa419_ilmn_R
ggagttcagacgtgtgctcttccgatctccgtatctcccttccctgat

SEQ ID NO: 1783 - DNA, 48 bp, Artificial Sequence
  Synthetic: Hsa420_ilmn_R
ggagttcagacgtgtgctcttccgatctgtttcgcgttttctggatgt

SEQ ID NO: 1784 - DNA, 48 bp, Artificial Sequence; identical to SEQ ID NO: 1783
  Synthetic: Hsa421_ilmn_R

SEQ ID NO: 1785 - DNA, 48 bp, Artificial Sequence
  Synthetic: Hsa422_ilmn_R
ggagttcagacgtgtgctcttccgatctctcatttggcagcctcagac

SEQ ID NO: 1786 - DNA, 48 bp, Artificial Sequence
  Synthetic: Hsa423_ilmn_R
ggagttcagacgtgtgctcttccgatctgacttctgtgtgttccgtgg

SEQ ID NO: 1787 - DNA, 48 bp, Artificial Sequence
  Synthetic: Hsa424_ilmn_R
ggagttcagacgtgtgctcttccgatcttgtaaggagctggctgacct

SEQ ID NO: 1788 - DNA, 50 bp, Artificial Sequence
  Synthetic: Hsa425_ilmn_R
ggagttcagacgtgtgctcttccgatcttgcttgttggatttttgtcttg

SEQ ID NO: 1789 - DNA, 48 bp, Artificial Sequence; identical to SEQ ID NO: 1758
  Synthetic: Hsa426_ilmn_R

SEQ ID NO: 1790 - DNA, 48 bp, Artificial Sequence; identical to SEQ ID NO: 1729
  Synthetic: Hsa427_ilmn_R

SEQ ID NO: 1791 - DNA, 48 bp, Artificial Sequence
  Synthetic: Hsa428_ilmn_R
ggagttcagacgtgtgctcttccgatctagccttaccctggcatcttt

SEQ ID NO: 1792 - DNA, 48 bp, Artificial Sequence
  Synthetic: Hsa429_ilmn_R
ggagttcagacgtgtgctcttccgatctagctggaggtagtggagcaa

SEQ ID NO: 1793 - DNA, 48 bp, Artificial Sequence
  Synthetic: Hsa430_ilmn_R
ggagttcagacgtgtgctcttccgatctggcctcagaatccacaaaga

SEQ ID NO: 1794 - DNA, 48 bp, Artificial Sequence; identical to SEQ ID NO: 1793
  Synthetic: Hsa431_ilmn_R

SEQ ID NO: 1795 - DNA, 48 bp, Artificial Sequence; identical to SEQ ID NO: 1771
  Synthetic: Hsa432_ilmn_R

SEQ ID NO: 1796 - DNA, 52 bp, Artificial Sequence; identical to SEQ ID NO: 1756
  Synthetic: Hsa433_ilmn_R

SEQ ID NO: 1797 - DNA, 48 bp, Artificial Sequence
  Synthetic: Hsa434_ilmn_R
ggagttcagacgtgtgctcttccgatctctctgccgcaatacaggaac

SEQ ID NO: 1798 - DNA, 47 bp, Artificial Sequence
  Synthetic: Hsa435_ilmn_R
ggagttcagacgtgtgctcttccgatctgtttcactgggctctgacg

SEQ ID NO: 1799 - DNA, 48 bp, Artificial Sequence; identical to SEQ ID NO: 1726
  Synthetic: Hsa436_ilmn_R

SEQ ID NO: 1800 - DNA, 49 bp, Artificial Sequence; identical to SEQ ID NO: 1778
  Synthetic: Hsa437_ilmn_R

SEQ ID NO: 1801 - DNA, 48 bp, Artificial Sequence
  Synthetic: Hsa438_ilmn_R
ggagttcagacgtgtgctcttccgatctcccagcctgcttctgattta

SEQ ID NO: 1802 - DNA, 48 bp, Artificial Sequence
  Synthetic: Hsa439_ilmn_R
ggagttcagacgtgtgctcttccgatctgaagtgcctgaaacccaaag

SEQ ID NO: 1803 - DNA, 48 bp, Artificial Sequence; identical to SEQ ID NO: 1719
  Synthetic: Hsa440_ilmn_R

SEQ ID NO: 1804 - DNA, 8729 bp, Artificial Sequence
  Synthetic: NLS-Cas3-10aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggggggcagcggaagtagtggcgggagtgggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1805 - DNA, 8750 bp, Artificial Sequence
  Synthetic: NLS-Cas3-17aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcacagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1806 - DNA, 8789 bp, Artificial Sequence
  Synthetic: NLS-Cas3-30aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1807 - DNA, 8819 bp, Artificial Sequence
  Synthetic: NLS-Cas3-40aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggagcggctcaagtggtggaagcggctcaagtcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1808 - DNA, 8729 bp, Artificial Sequence
  Synthetic: NLS-nCas3-10aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggggggcagcggaagtagtggcgggagtgggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1809 - DNA, 8750 bp, Artificial Sequence
  Synthetic: NLS-nCas3-17aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcacagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1810 - DNA, 8789 bp, Artificial Sequence
  Synthetic: NLS-nCas3-30aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1811 - DNA, 8819 bp, Artificial Sequence
  Synthetic: NLS-nCas3-40aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggagcggctcaagtggtggaagcggctcaagtcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1812 - DNA, 8729 bp, Artificial Sequence
  Synthetic: NLS-dCas3-10aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgccatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggggggcagcggaagtagtggcgggagtgggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1813 - DNA, 8750 bp, Artificial Sequence
  Synthetic: NLS-dCas3-17aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgccatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcacagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1814 - DNA, 8750 bp, Artificial Sequence; identical to SEQ ID NO: 1813
  Synthetic: NLS-dCas3-30aa-FokI

SEQ ID NO: 1815 - DNA, 8819 bp, Artificial Sequence
  Synthetic: NLS-dCas3-40aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgccatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggagcggctcaagtggtggaagcggctcaagtcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

---

The invention claimed is:

1. A composition comprising:
   a first engineered Class 1 Type I CRISPR-Cas effector complex comprising,
      a first Cse2 subunit protein, a first Cas5 subunit protein, a first Cas6 subunit protein, and a first Cas7 subunit protein,
      a first fusion protein comprising a first Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FokI, and wherein the first linker polypeptide has a length of between 10 amino acids to 40 amino acids, and
      a first guide polynucleotide comprising a first spacer capable of binding a first nucleic acid target sequence; and
   a second engineered Class 1 Type I CRISPR-Cas effector complex comprising,
      a second Cse2 subunit protein, a second Cas5 subunit protein, a second Cas6 subunit protein, and a second Cas7 subunit protein,
      a second fusion protein comprising a second Cas8 subunit protein and a second FokI, wherein the N-terminus of the second Cas8 subunit protein or the C-terminus of the second Cas8 subunit protein is covalently connected by a second linker polypeptide to the C-terminus or N-terminus, respectively, of the second FokI, and wherein the second linker polypeptide has a length of between 10 amino acids to 40 amino acids, and
      a second guide polynucleotide comprising a second spacer capable of binding a second nucleic acid target sequence, wherein a protospacer adjacent motif (PAM) of the second nucleic acid target sequence and a PAM of the first nucleic acid target sequence have an interspacer distance between 20 base pairs to 42 base pairs.

2. The composition of claim 1, wherein the first linker polypeptide has a length of between 15 amino acids and 30 amino acids.

3. The composition of claim 2, wherein the first linker polypeptide has a length of between 17 amino acids and 20 amino acids.

4. The composition of claim 1, wherein the second linker polypeptide has a length of between 15 amino acids and 30 amino acids.

5. The composition of claim 4, wherein the second linker polypeptide has a length of between 17 amino acids and 20 amino acids.

6. The composition of claim 1, wherein the length of the first linker polypeptide and the second linker polypeptide are the same.

7. The composition of claim 1, wherein the interspacer distance of the PAM of the second nucleic acid target sequence and the PAM of the first nucleic acid target sequence is between 22 base pairs to 40 base pairs.

8. The composition of claim 7, wherein the interspacer distance of the PAM of the second nucleic acid target sequence and the PAM of the first nucleic acid target sequence is between 26 base pairs to 36 base pairs.

9. The composition of claim 8, wherein the interspacer distance of the PAM of the second nucleic acid target sequence and the PAM of the first nucleic acid target sequence is between 29 base pairs to 35 base pairs.

10. The composition of claim 9, wherein the interspacer distance of the PAM of the second nucleic acid target sequence and the PAM of the first nucleic acid target sequence is between 30 base pairs to 34 base pairs.

11. The composition of claim 1, wherein the first FokI and the second FokI are monomeric subunits capable of associating to form a homodimer.

12. The composition of claim 1, wherein the first FokI and the second FokI are distinct monomeric subunits capable of associating to form a heterodimer.

13. The composition of claim 1, wherein the N-terminus of the first Cas8 subunit protein is covalently connected by the first linker polypeptide to the C-terminus of the first FokI.

14. The composition of claim 1, wherein the C-terminus of the first Cas8 subunit protein is covalently connected by a first linker polypeptide to the N-terminus of the first FokI.

15. The composition of claim 1, wherein the N-terminus of the second Cas8 subunit protein is covalently connected by the second linker polypeptide to the C-terminus of the second FokI.

16. The composition of claim 1, wherein the C-terminus of the second Cas8 subunit protein is covalently connected by a second linker polypeptide to the N-terminus of the second FokI.

17. The composition of claim 1, wherein the first Cas8 subunit protein and the second Cas8 subunit protein each comprises identical amino acid sequences.

18. The composition of claim 17, wherein the first Cse2 subunit protein and the second Cse2 subunit protein each comprises identical amino acid sequences, the first Cas5 subunit protein and the second Cas5 subunit protein each comprises identical amino acid sequences, the first Cas6 subunit protein and the second Cas6 subunit protein each comprises identical amino acid sequences, and the first Cas7 subunit protein and the second Cas7 subunit protein each comprises identical amino acid sequences.

19. The composition of claim 1, wherein the first guide polynucleotide comprises RNA.

20. The composition of claim 1, wherein the second guide polynucleotide comprises RNA.

* * * * *

UNITED STATES PATENT AND TRADEMARK OFFICE
CERTIFICATE OF CORRECTION

PATENT NO. : 10,227,576 B1
APPLICATION NO. : 16/104875
DATED : March 12, 2019
INVENTOR(S) : Peter Sean Cameron, Sanne Eveline Klompe and Samuel Henry Sternberg It is certified that error appears in the above-identified patent and that said Letters Patent is hereby corrected as shown below:

On the Title Page

Item (72), Inventors, Line 4, delete "Stemberg", and insert -- Sternberg --, therefor.

In the Specification

In Column 3, Line 50, delete "FolkI", and insert -- FokI --, therefor.

In Column 3, Line 54, delete "FolkI", and insert -- FokI --, therefor.

In Column 4, Line 1, delete "FolkI", and insert -- FokI --, therefor.

In Column 4, Line 27, delete "FolkI", and insert -- FokI --, therefor.

In Column 4, Line 30, delete "FolkI", and insert -- FokI --, therefor.

In Column 4, Line 32, delete "FolkI", and insert -- FokI --, therefor.

In Column 7, Line 64, delete "FolkI", and insert -- FokI --, therefor.

In Column 7, Line 66, delete "FolkI", and insert -- FokI --, therefor.

In Column 8, Line 1, delete "FolkI", and insert -- FokI --, therefor.

In Column 10, Line 2, delete "FolkI", and insert -- FokI --, therefor.

In Column 27, Line 18, delete "FolkI", and insert -- FokI --, therefor.

In Column 27, Line 39, delete "FolkI", and insert -- FokI --, therefor.

Signed and Sealed this
Twelfth Day of November, 2019

Andrei Iancu
*Director of the United States Patent and Trademark Office*

CERTIFICATE OF CORRECTION (continued)
U.S. Pat. No. 10,227,576 B1

In Column 27, Line 46, delete "FolkI", and insert -- FokI --, therefor.

In Column 33, Line 14, Table 4-continued, delete "FokI-30aa-Cas8 His6-", and insert -- FokI–30aa–Cas8_His6– --, therefor.

In Column 33, Line 19, Table 4-continued, delete "FokI-30aa-Cas8 His6-", and insert -- FokI–30aa–Cas8_His6– --, therefor.

In Column 34, Line 52, delete "FolkI", and insert -- FokI --, therefor.

In Column 36, Line 54, Table 8, delete "(IIsa07)", and insert -- (Hsa07) --, therefor.

In Column 38, Line 17, delete "FolkI", and insert -- FokI --, therefor.

In Column 38, Line 37, delete "FolkI", and insert -- FokI --, therefor.

In Column 41, Line 52, delete "FolkI", and insert -- FokI --, therefor.

In Column 41, Line 58, delete "FolkI", and insert -- FokI --, therefor.

In Column 42, Line 4, delete "FolkI", and insert -- FokI --, therefor.

In Column 42, Line 59, delete "FolkI", and insert -- FokI --, therefor.

In Column 42, Line 66, delete "FolkI", and insert -- FokI --, therefor.

In Column 43, Line 8, delete "FolkI", and insert -- FokI --, therefor.

In Column 43, Line 39, delete "FolkI", and insert -- FokI --, therefor.

In Column 43, Line 43, delete "FolkI", and insert -- FokI --, therefor.

In Column 43, Line 45, delete "FolkI", and insert -- FokI --, therefor.

In Column 43, Line 50, delete "FolkI", and insert -- FokI --, therefor.

In Column 43, Line 66, delete "FolkI", and insert -- FokI --, therefor.

In Column 44, Line 4, delete "FolkI", and insert -- FokI --, therefor.

In Column 44, Line 6, delete "FolkI", and insert -- FokI --, therefor.

In Column 44, Line 12, delete "FolkI", and insert -- FokI --, therefor.

In Column 46, Line 1, delete "FolkI", and insert -- FokI --, therefor.

CERTIFICATE OF CORRECTION (continued)
U.S. Pat. No. 10,227,576 B1

In Column 46, Line 9, delete "FolkI", and insert -- FokI --, therefor.

In Column 46, Line 11, delete "FolkI", and insert -- FokI --, therefor.

In Column 46, Line 41, delete "FolkI", and insert -- FokI --, therefor.

In Column 46, Line 45, delete "FolkI", and insert -- FokI --, therefor.

In Column 50, Line 36, delete "FolkI", and insert -- FokI --, therefor.

In Column 50, Line 53, delete "FolkI", and insert -- FokI --, therefor.

In Column 51, Line 59, delete "FolkI and the second FolkI", and insert -- FokI and the second FokI --, therefor.

In Column 51, Line 65, delete "FolkI and the second FolkI", and insert -- FokI and the second FokI --, therefor.

In Column 52, Line 14, delete "FolkI", and insert -- FokI --, therefor.

In Column 52, Line 21, delete "FolkI", and insert -- FokI --, therefor.

In Column 52, Line 28, delete "FolkI", and insert -- FokI --, therefor.

In Column 54, Line 55, delete "FolkI", and insert -- FokI --, therefor.

In Column 54, Line 59, delete "FolkI", and insert -- FokI --, therefor.

In Column 54, Line 64, delete "FolkI", and insert -- FokI --, therefor.

In Column 54, Line 67, delete "FolkI", and insert -- FokI --, therefor.

In Column 58, Line 34, Table 11, insert the following before the first line of data:

| -- Cse2 | Strep-tag® II-HRV3C | N | SEQ ID NO:390 | E. coli | SEQ ID NO:391 |
| Cse2 | His6–HRV3C | N | SEQ ID NO:392 | E. coli | SEQ ID NO:393 |
| Cse2 | NLS | N | SEQ ID NO:394 | Mammalian | SEQ ID NO:395 |
| Cas5 | NLS | N | SEQ ID NO:396 | Mammalian | SEQ ID NO:397 --, therefor. |

In Column 59, Line 1, delete "FolkI", and insert -- FokI --, therefor.

In Column 59, Line 6, delete "FolkI", and insert -- FokI --, therefor.

In Column 59, Line 9, delete "FolkI", and insert -- FokI --, therefor.

In Column 61, Line 16, delete "FolkI", and insert -- FokI --, therefor.

CERTIFICATE OF CORRECTION (continued)

In Column 61, Line 67, delete "folkI-cas8,", and insert -- fokI–cas8, --, therefor.

In Column 62, Line 11, delete "FolkI", and insert -- FokI --, therefor.

In Column 62, Line 20, delete "FolkI", and insert -- FokI --, therefor.

In Column 63, Line 57, delete "FolkI", and insert -- FokI --, therefor.

In Column 64, Line 9, delete "FolkI (FolkI nuclease", and insert -- FokI (FokI nuclease --, therefor.

In Column 65, Line 38, delete "FolkI", and insert -- FokI --, therefor.

In Column 65, Line 53, delete "FolkI", and insert -- FokI --, therefor.

In Column 66, Line 11, Table 18, delete "NLS-IIA-FokI;", and insert -- NLS-HA-FokI; --, therefor.

In Column 71, Line 60, delete "M cm$^{-1}$" and insert -- M$^{-1}$cm$^{-1}$ --, therefor.

In Column 72, Line 20, delete "FolkI", and insert -- FokI --, therefor.

In Column 78, Line 57, delete "FolkI", and insert -- FokI --, therefor.

In Column 78, Line 61, delete "FolkI", and insert -- FokI --, therefor.

In Column 79, Line 17, delete "FolkI", and insert -- FokI --, therefor.

In Column 80, Line 6, delete "FolkI", and insert -- FokI --, therefor.

In Column 80, Line 8, delete "FolkI", and insert -- FokI --, therefor.

In Column 80, Line 23, delete "FolkI", and insert -- FokI --, therefor.

In Column 80, Line 28, delete "FolkI", and insert -- FokI --, therefor.

In Column 81, Line 21, delete "FolkI", and insert -- FokI --, therefor.

In Column 81, Line 27, delete "FolkI", and insert -- FokI --, therefor.

In Column 81, Line 34, delete "FolkI", and insert -- FokI --, therefor.

In Column 81, Line 51, delete "FolkI", and insert -- FokI --, therefor.

In Column 81, Line 57, delete "FolkI", and insert -- FokI --, therefor.

In Column 82, Line 6, delete "FolkI", and insert -- FokI --, therefor.

CERTIFICATE OF CORRECTION (continued)
U.S. Pat. No. 10,227,576 B1

In Column 82, Line 55, delete "FolkI", and insert -- FokI --, therefor.

In Column 82, Line 58, delete "FolkI", and insert -- FokI --, therefor.

In Column 82, Line 60, delete "FolkI", and insert -- FokI --, therefor.

In Column 82, Line 63, delete "FolkI", and insert -- FokI --, therefor.

In Column 82, Line 65, delete "FolkI", and insert -- FokI --, therefor.

In Column 83, Line 3, delete "FolkI", and insert -- FokI --, therefor.

In Column 83, Line 6, delete "FolkI", and insert -- FokI --, therefor.

In Column 83, Line 11, delete "FolkI", and insert -- FokI --, therefor.

In Column 83, Line 12, delete "FolkI", and insert -- FokI --, therefor.

In Column 83, Line 13, delete "FolkI-Cascade (Cas7-NLS) complex; FolkI-Cascade", and insert -- FokI-Cascade (Cas7-NLS) complex; FokI-Cascade --, therefor.

In Column 83, Line 14, delete "FolkI", and insert -- FokI --, therefor.

In Column 83, Line 16, delete "FolkI", and insert -- FokI --, therefor.

In Column 83, Line 25, delete "FolkI", and insert -- FokI --, therefor.

In Column 84, Line 43, delete "FolkI", and insert -- FokI --, therefor.

In Column 84, Line 45, delete "FolkI", and insert -- FokI --, therefor.

In Column 84, Line 56, delete "FolkI", and insert -- FokI --, therefor.

In Column 84, Line 60, delete "FolkI", and insert -- FokI --, therefor.

In Column 87, Line 36, delete "FolkI", and insert -- FokI --, therefor.

In Column 87, Line 38, delete "FolkI", and insert -- FokI --, therefor.

In Column 87, Line 39, delete "FolkI", and insert -- FokI --, therefor.

In Column 87, Line 40, delete "FolkI", and insert -- FokI --, therefor.

In Column 87, Line 46, delete "FolkI", and insert -- FokI --, therefor.

In Column 87, Line 54, delete "FolkI", and insert -- FokI --, therefor.

CERTIFICATE OF CORRECTION (continued)
U.S. Pat. No. 10,227,576 B1

In Column 90, Line 19, delete "FolkI", and insert -- FokI --, therefor.

In Column 90, Line 24, delete "FolkI", and insert -- FokI --, therefor.

In Column 90, Line 48, delete "FolkI", and insert -- FokI --, therefor.

In Column 90, Line 57, delete "FolkI", and insert -- FokI --, therefor.

In Column 91, Line 17, delete "FolkI", and insert -- FokI --, therefor.

In Column 92, Line 65, delete "FolkI", and insert -- FokI --, therefor.

In Column 93, Line 5, delete "FolkI", and insert -- FokI --, therefor.

In Column 93, Line 12, delete "FolkI", and insert -- FokI --, therefor.

In Column 93, Line 21, delete "FolkI", and insert -- FokI --, therefor.

In Column 99, Line 30, delete "Cas", and insert -- cas --, therefor.

In Column 104, Line 19, delete "FolkI", and insert -- FokI --, therefor.

In Column 104, Line 28, delete "FolkI", and insert -- FokI --, therefor.

In Column 104, Line 45, delete "FolkI", and insert -- FokI --, therefor.

In Column 104, Line 49, delete "FolkI", and insert -- FokI --, therefor.

In Column 105, Line 11, delete "FolkI", and insert -- FokI --, therefor.

In Column 105, Line 17, delete "FolkI", and insert -- FokI --, therefor.

In Column 106, Line 11, delete "FolkI", and insert -- FokI --, therefor.

In Column 106, Line 20, delete "FolkI", and insert -- FokI --, therefor.

In Column 107, Line 64, delete "FolkI", and insert -- FokI --, therefor.

In Column 108, Line 18, delete "FolkI", and insert -- FokI --, therefor.

In Column 108, Line 19, delete "30-aa linker", and insert -- 30-aa linker. --, therefor.

In Column 108, Line 26, delete "FolkI", and insert -- FokI --, therefor.

In Column 109, Line 19, delete "FolkI", and insert -- FokI --, therefor.

In Column 109, Line 29, delete "FolkI", and insert -- FokI --, therefor.

In Column 109, Line 39, delete "FolkI", and insert -- FokI --, therefor.

In Column 109, Line 41, delete "FolkI", and insert -- FokI --, therefor.

In Column 109, Line 54, delete "FolkI", and insert -- FokI --, therefor.

In Column 110, Line 15, delete "FolkI", and insert -- FokI --, therefor.

In Column 110, Line 17, delete "FolkI", and insert -- FokI --, therefor.

In Column 110, Line 26, delete "FolkI", and insert -- FokI --, therefor.

In Column 110, Line 33, delete "FolkI", and insert -- FokI --, therefor.

In Column 110, Line 35, delete "FolkI", and insert -- FokI --, therefor.

In Column 110, Line 55, delete "FolkI", and insert -- FokI --, therefor.

In Column 110, Line 65, delete "FolkI", and insert -- FokI --, therefor.

In Column 111, Line 2, delete "FolkI", and insert -- FokI --, therefor.

In Column 111, Line 41, delete "FolkI", and insert -- FokI --, therefor.

In Column 111, Line 66, delete "FolkI", and insert -- FokI --, therefor.

In the Claims

In Column 112, Line 37, Claim 1, delete "to", and insert -- and --, therefor.

In Column 112, Line 53, Claim 1, delete "to", and insert -- and --, therefor.

In Column 112, Line 61, Claim 1, delete "to", and insert -- and --, therefor.

In Column 113, Line 7, Claim 6, delete "length", and insert -- lengths --, therefor.

In Column 113, Line 13, Claim 7, delete "to", and insert -- and --, therefor.

In Column 113, Line 17, Claim 8, delete "to", and insert -- and --, therefor.

In Column 113, Line 22, Claim 9, delete "to", and insert -- and --, therefor.

In Column 113, Line 26, Claim 10, delete "to", and insert -- and --, therefor.